US011866462B2

(12) United States Patent
Nakai et al.

(10) Patent No.: US 11,866,462 B2
(45) Date of Patent: Jan. 9, 2024

(54) RECOMBINANT ADENO-ASSOCIATED VIRAL VECTORS

(71) Applicant: OREGON HEALTH & SCIENCE UNIVERSITY, Portland, OR (US)

(72) Inventors: Hiroyuki Nakai, Portland, OR (US); Kei Adachi, Portland, OR (US)

(73) Assignee: OREGON HEALTH & SCIENCE UNIVERSITY, Portland, OR (US)

( * ) Notice: Subject to any disclaimer, the term of this patent is extended or adjusted under 35 U.S.C. 154(b) by 283 days.

(21) Appl. No.: 16/098,814

(22) PCT Filed: May 3, 2017

(86) PCT No.: PCT/US2017/030885
§ 371 (c)(1),
(2) Date: Nov. 2, 2018

(87) PCT Pub. No.: WO2017/192750
PCT Pub. Date: Nov. 9, 2017

(65) Prior Publication Data
US 2019/0135871 A1 May 9, 2019

Related U.S. Application Data

(60) Provisional application No. 62/331,898, filed on May 4, 2016.

(51) Int. Cl.
*C12N 15/86* (2006.01)
*A61K 39/23* (2006.01)
*C07K 14/005* (2006.01)
*A61K 38/00* (2006.01)

(52) U.S. Cl.
CPC ............ *C07K 14/005* (2013.01); *C12N 15/86* (2013.01); *A61K 38/00* (2013.01); *C12N 2750/14122* (2013.01); *C12N 2750/14143* (2013.01); *C12N 2830/38* (2013.01)

(58) Field of Classification Search
CPC .......... C12N 15/86; C12N 2750/14122; C07K 14/005
See application file for complete search history.

(56) References Cited

U.S. PATENT DOCUMENTS

2015/0232953 A1 8/2015 Schaffer et al.

FOREIGN PATENT DOCUMENTS

| | | | | |
|---|---|---|---|---|
| WO | WO 00/28061 | | * | 5/2000 |
| WO | WO 2013/029030 | A1 | * | 2/2013 |
| WO | 2013159036 | A1 | | 4/2013 |
| WO | 2015191508 | A1 | | 6/2015 |
| WO | 2016049230 | A1 | | 9/2015 |
| WO | 2016054554 | A1 | | 10/2015 |
| WO | 2017192750 | A1 | | 11/2017 |

OTHER PUBLICATIONS

Lisowski et al., 2013, Geneseq Accession No. BAL41774, computer printout, pp. 32-33.*
Schaffer et al., 2012, Geneseq Accession No. BAE48326, computer printout, pp. 1-2.*
Asokan et al., Jan. 21, 2016, US 20160017005 A1.*
Gao et al., 2003, Geneseq Accession No. ABR62762, computer printout, pp. 1-2.*
Lisowski et al., 2013, Geneseq Accession No. BAL41774, computer printout, pp. 1-2, (Lisowski SEQ).*
Wilson et al., 2000 (Geneseq Accession No. AAY71167, computer printout, pp. 1-2) (Wilson B).*
Schaffer et al., 2012 (Geneseq Accession No. BAE48325, computer printout pp. 1-2).*
PCT/US2017/030885, International Search Report and Written Opinion, dated Sep. 15, 2017, 15 pages.
PCT/US2017/030885, Invitation to Pay Additional Fees and, Where Applicable, Protest Fee, dated Jul. 12, 2017, 2 pages.
PCT/US2017/030885, Response to Invitation to Pay Additional Fees and, Where Applicable, Protest Fee, dated Aug. 11, 2017, 4 pages.

* cited by examiner

*Primary Examiner* — Shin Lin Chen
(74) *Attorney, Agent, or Firm* — Wilson Sonsini Goodrich & Rosati

(57) ABSTRACT

Disclosed are adeno-associated viral vectors and plasmids encoding the same. Also disclosed are methods of using adeno-associated viral vectors to deliver a protein of interest to the subject. The disclosed vectors have phenotypes including but not limited to increased retention in the blood of a subject, avoidance of the liver, and transduction of the brain and other tissues.

7 Claims, 6 Drawing Sheets

Specification includes a Sequence Listing.

RECOMBINANT ADENO-ASSOCIATED VIRAL VECTORS

RELATED CASES

This application is a national stage entry of PCT/US2017/030885, filed May 3, 2017, which claims priority to U.S. Provisional Application No. 62/331,898, filed May 4, 2016 and titled "RECOMBINANT ADENO ASSOCIATED VIRAL VECTORS," each of which is hereby incorporated by reference in its entirety.

ACKNOWLEDGEMENT OF GOVERNMENT SUPPORT

This invention was made with government support under NS088399 awarded by the National Institutes of Health. The government has certain rights in the invention.

TECHNICAL FIELD

Generally, the field involves adeno-associated viral vectors used in gene delivery. More specifically, the field involves adeno-associated viral vectors with particular phenotypes such as augmented retention in the blood of a subject, avoidance of the liver, and tracking to the brain and other tissues.

BACKGROUND

Recombinant adeno-associated virus (rAAV) is among the most promising vectors for in vivo gene delivery. The usefulness of rAAV vectors has been expanded since a number of naturally occurring new serotypes and subtypes were isolated from human and non-human primate tissues (Gao G et al., *J Virol* 78, 6381-6388 (2004) and Gao G P et al., *Proc Natl Acad Sci USA* 99, 11854-11859 (2002); both of which are incorporated by reference herein). Among the newly-identified AAV isolates, AAV serotype 8 (AAV8) and AAV serotype 9 (AAV9) have gained attention because rAAV vectors derived from these two serotypes can transduce various organs including the liver, heart, skeletal muscles and central nervous system with high efficiency following systemic administration (Ghosh A et al., *Mol Ther* 15, 750-755 (2007); Pacak C A et al., *Circ Res* 99, 3-9 (2006); Inagaki K et al., *Mol Ther* 14, 45-53 (2006); Zhu T et al., *Circulation* 112, 2650-2659 (2005); Wang Z et al., *Nat Biotechnol* 23, 321-328 (2005); Nakai H et al., *J Virol* 79, 214-224 (2005); and Foust K D et al., *Nature Biotechnol* 23, 321-328 (2009); all of which are incorporated by reference herein). This robust transduction by rAAV8 and 9 vectors has been presumed to be ascribed to strong tropism for these cell types, efficient cellular uptake of vectors, and/or rapid uncoating of virion shells in cells (Thomas C E et al., *J Virol* 78, 3110-3122 (2004); incorporated by reference herein). In addition, emergence of capsid-engineered rAAV with better performance has significantly broadened the utility of rAAV as a vector toolkit (Asokan A et al., *Mol Ther* 20, 699-708 (2012); incorporated by reference herein).

A proof-of-concept using rAAV-mediated gene therapy has been shown in many preclinical animal models of human diseases. Phase I/II clinical studies have shown promising results for the treatment for hemophilia B (Nathwani A C et al., *N Engl J Med* 71, 1994-2004 (2014); incorporated by reference herein); lipoprotein lipase deficiency (Carpentier A C et al., *J Clin Endocrinol Metab* 97, 1635-1644 (2012); incorporated by reference herein); Leber congenital amaurosis (Jacobson S G et al., Arch Ophthalmol 130, 9-24 (2012) and Pierce E A and Bennett J, Cold Spring Harb Perspect Med 5, a017285 (2015); both of which are incorporated by reference herein), among others (reviewed in Mingozzi F and High K A, *Nat Rev Genet* 12, 341-355 (2011); incorporated by reference herein). Despite this promise, human studies have also revealed unexpected issues and potential challenges in rAAV-mediated gene therapy (Manno C S et al., *Nat Med* 12, 342-347 (2006); incorporated by reference herein).

Although rAAV vectors have widely been used in preclinical animal studies and have been tested in clinical safety studies in many diseases, the current rAAV-mediated gene delivery systems face challenges, especially with regard to broader clinical applications, potentially due to a lack of understanding of the mechanisms of rAAV transduction in vivo. Mechanistic studies of the AAV capsid have been a significant challenge due to the multifunctional nature of the AAV viral capsid protein, mutants of which result in a wide array of phenotypes. Such phenotypes include efficiency of capsid assembly, ability to interact with AAV viral nonstructural proteins (i.e., Rep and AAP proteins), ability to interact with components in body fluid and extracellular matrix, blood clearance rates, vascular permeability, antigenicity, reactivity to neutralizing antibodies, tissue/organ/cell type tropism, efficiency of cell attachment and internalization, intracellular trafficking routes, virion uncoating rates, and so on. Even with information about the atomic structure of the AAV capsid, the relationships between mutations of the AAV capsid amino acid sequence and those of AAV phenotypes are difficult to predict. Many of these phenotypes have significant influences on the yield of rAAV vector production and the degree of efficiency in overcoming various barriers toward establishing infection/transduction; therefore, understanding of the capsid biology is imperative to improve the current system and develop novel vectors with desired properties.

SUMMARY

Disclosed are adeno-associated viral vectors that include a capsid protein. The capsid protein may include one or more of SEQ ID NO: 8, SEQ ID NO: 9, SEQ ID NO: 10, SEQ ID NO: 11, SEQ ID NO: 12, SEQ ID NO: 13, and/or SEQ ID NO: 14 alone or in combination and provided that the remainder of the capsid protein is derived from AAV1, AAV2, AAV4, AAV5, AAV6, AAV7, or AAV8. In some embodiments, the capsid protein is of SEQ ID NO: 15, SEQ ID NO: 145, or SEQ ID NO: 146 and is mutated to comprise SEQ ID NO: 8, SEQ ID NO: 9, SEQ ID NO: 10, SEQ ID NO: 11, SEQ ID NO: 12, SEQ ID NO: 13, or SEQ ID NO: 14, alone or in combination at the corresponding sequences in SEQ ID NO: 15, SEQ ID NO: 145, or SEQ ID NO: 146. In still further embodiments, the capsid protein is of SEQ ID NO: 15 comprising one or more of the following amino acid substitutions: SEQ ID NO: 1→SEQ ID NO: 8, SEQ ID NO: 2→SEQ ID NO: 9, SEQ ID NO: 3→SEQ ID NO: 10, SEQ ID NO: 4→SEQ ID NO: 11, SEQ ID NO: 5→SEQ ID NO: 12, SEQ ID NO: 6→SEQ ID NO: 13, SEQ ID NO: 7→SEQ ID NO: 14; or SEQ ID NO: 143→SEQ ID NO: 144.

In still further embodiments, the virus persists in the blood of a subject at least 24 hours after injection of the virus into the subject. In such embodiments, the capsid protein can comprise one or more of the following amino acid substitutions SEQ ID NO: 4→SEQ ID NO: 11; SEQ ID NO: 6→SEQ ID NO: 13; or SEQ ID NO: 7→SEQ ID NO: 14. In still further embodiments, the capsid protein has a sequence of SEQ ID NO: 25, SEQ ID NO: 26, SEQ ID NO: 28, SEQ ID NO: 29, SEQ ID NO: 30, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 50, SEQ ID NO: 57, SEQ ID NO: 58, SEQ ID NO: 60, SEQ ID NO: 61, SEQ ID NO: 62, SEQ ID NO: 65, SEQ ID NO: 66, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 89, SEQ ID NO: 90, SEQ ID NO: 91, SEQ ID NO: 92, SEQ ID NO: 93, SEQ ID NO: 94, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 114, SEQ ID NO: 118, SEQ ID NO: 121, SEQ ID NO: 122, SEQ ID NO: 124, SEQ ID NO: 125, SEQ ID NO: 126, SEQ ID NO: 129, SEQ ID NO: 130, SEQ ID NO: 136, SEQ ID NO: 137, SEQ ID NO: 138, SEQ ID NO: 139, SEQ ID NO: 140, SEQ ID NO: 141, or SEQ ID NO: 142.

In still further embodiments, the vector persists in the blood of a subject at least 72 hours after injection of the vector into the subject. In some embodiments, the capsid protein comprises SEQ ID NO: 6 and further comprises a SEQ ID NO: 7→SEQ ID NO: 14 amino acid substitution mutation. In still further embodiments, the vector comprises a capsid protein of SEQ ID NO: 23, SEQ ID NO: 27, SEQ ID NO: 28, SEQ ID NO: 55, SEQ ID NO: 87, SEQ ID NO: 91, SEQ ID NO: 92, SEQ ID NO: 107, or SEQ ID NO: 123.

In still further embodiments, the vector concentrates in the liver of a subject at a concentration of 10% or less of that the concentration of an adeno-associated virus comprising a capsid of SEQ ID NO: 15. In some embodiments, the capsid comprises one or more of a SEQ ID NO: 4→SEQ ID NO: 11 amino acid substitution mutation and/or a SEQ ID NO: 6→SEQ ID NO: 13 amino acid substitution mutation. In still further embodiments, the viral vector comprises a capsid protein of SEQ ID NO: 17, SEQ ID NO: 18, SEQ ID NO: 20, SEQ ID NO: 21, SEQ ID NO: 22, SEQ ID NO: 25, SEQ ID NO: 26, SEQ ID NOs: 29-46, SEQ ID NO: 49, SEQ ID NO: 50, SEQ ID NO: 53, SEQ ID NO: 54, SEQ ID NO: 57, SEQ ID NO: 58, SEQ ID NOs: 61-70, SEQ ID NOs: 72-86, SEQ ID NO: 89, SEQ ID NOs: 93-102, SEQ ID NOs: 105-110, SEQ ID NO: 113, SEQ ID NO: 117, SEQ ID NO: 118, SEQ ID NO: 121, SEQ ID NO: 125, SEQ ID NO: 126, or SEQ ID NOs: 129-142.

In still further embodiments, the vector transduces the brain of a subject at least 4× more readily than an adeno-associated virus comprising a capsid of SEQ ID NO: 15. In still further embodiments, the capsid comprises a SEQ ID NO: 7→SEQ ID NO: 14 amino acid substitution mutation. It can further comprise a SEQ ID NO: 5→SEQ ID NO: 12 amino acid substitution mutation and can also comprise SEQ ID NO: 6. In still further embodiments, the vector comprises a capsid of SEQ ID NO: 23, SEQ ID NO: 24, SEQ ID NO: 26, SEQ ID NO: 27, SEQ ID NO: 28, SEQ ID NO: 30, SEQ ID NO: 40, SEQ ID NO: 44, SEQ ID NO: 50, SEQ ID NO: 54, SEQ ID NO: 55, SEQ ID NO: 60, SEQ ID NO: 71, SEQ ID NO: 88, SEQ ID NO: 89, SEQ ID NO: 90, SEQ ID NO: 92, SEQ ID NO: 104, SEQ ID NO: 105, SEQ ID NO: 108, SEQ ID NO: 114, SEQ ID NO: 120, SEQ ID NO: 122, SEQ ID NO: 124, SEQ ID NO: 126, and SEQ ID NO: 140.

In still further embodiments, the vector transduces one or more of pancreas, liver, skeletal muscle, visceral fat, heart, liver, lung and/or kidney of a subject at least 4× more readily than an adeno-associated virus comprising a capsid of SEQ ID NO: 15. In still further embodiments, the vector has a capsid protein comprising SEQ ID NO: 4, SEQ ID NO: 6 and also has a SEQ ID NO: 7→SEQ ID NO: 14 amino acid substitution mutation. In still further embodiments, the vector comprises a capsid of SEQ ID NO: 16, SEQ ID NO: 23, SEQ ID NO: 24, SEQ ID NO: 27, SEQ ID NO: 28, SEQ ID NO: 48, SEQ ID NO: 55, SEQ ID NO: 59, SEQ ID NO: 60, SEQ ID NO: 71, SEQ ID NO: 87, SEQ ID NO: 88, SEQ ID NO: 90, SEQ ID NO: 91, SEQ ID NO: 92, SEQ ID NO: 111, SEQ ID NO: 119, SEQ ID NO: 120, SEQ ID NO: 123, or SEQ ID NO: 124.

Also disclosed is a viral vector comprising a capsid protein of SEQ ID NO: 15, the capsid further comprising one or more of the following amino acid substitution mutations: S262N, A263S, S264T, T265S, A267G, N269S, D270N, N271D, H272N, or Y273A.

Also disclosed are polynucleotides that encode the disclosed adeno-associated viral vectors and methods of delivering a polynucleotide that encodes a protein of interest to a subject. That method comprises administering an effective amount of any of the disclosed adeno-associated viral vectors.

It is an object of the invention to create recombinant AAV vectors with delayed blood clearance following intravascular administration.

It is an object of the invention to create recombinant AAV vectors with an enhanced brain transduction relative to unmutated vectors.

It is an object of the invention to create recombinant AAV vectors that de-target the liver.

It is an object of the invention to create recombinant AAV vectors that can target tissues such as heart, lung, liver, kidney, pancreas, testis, skeletal muscle, and visceral fat.

It is an object of the invention to create recombinant AAV vectors that can penetrate the blood brain barrier.

It is an object of the invention to identify AAV capsid amino acid sequences responsible for delaying blood clearance following intravascular administration.

It is an object of the invention to identify AAV capsid amino acid mutations that enhance and suppress transduction in tissues such as the brain and liver.

SEQUENCE LISTING

Figure 1A:
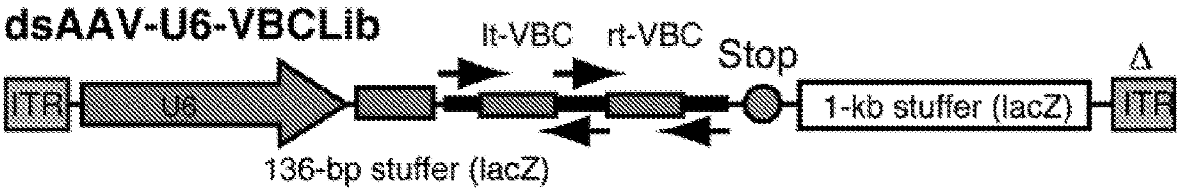
FIG. 1A is a map of an RNA barcode-expressing recombinant AAV (rAAV). Clone-specific DNA barcodes (lt- and rt-VBC; VBC, Virus Bar Code) are transcribed into RNA under the control of the human U6 snRNA gene promoter.

SEQ ID NOs: 1-8 are amino acid sequences of AAV1 (SEQ ID NO: 15).

SEQ ID NOs: 9-14 are amino acid sequences of AAV9 corresponding to the amino acid sequences of SEQ ID NOs: 1-8.

SEQ ID NO: 15 is wild type (unmutated) AAV1 capsid.

SEQ ID NOs: 16-142 are recombinant AAV1 capsid proteins with combinations of SEQ ID NOs: 9-14 included.

SEQ ID NO: 143 is an AAV1 sequence that corresponds to SEQ ID NO: 144 of AAV9.

SEQ ID NO: 144 is a AAV9 sequence determined herein to be important for persistence of AAV9 in blood.

SEQ ID NO: 145 is wild type (unmutated) AAV2 capsid.

SEQ ID NO: 146 is wild type (unmutated) AAV4 capsid.

DETAILED DESCRIPTION

Described herein are AAV vectors with engineered capsid proteins that have any of a number of phenotypes. Such phenotypes include increased retention in serum, enhanced targeting of the brain and other tissues (such as heart, lung, visceral fat, liver, pancreas, skeletal muscle and others.) The AAV vectors described herein comprise particular capsid protein sequences from AAV9 such as SEQ ID NO: 8, SEQ ID NO: 9, SEQ ID NO: 10, SEQ ID NO: 11, SEQ ID NO: 12, SEQ ID NO: 13, SEQ ID NO: 14, and SEQ ID NO: 144 as well as particular mutations within those sequences. The vectors are created by mutating the sequence of a capsid protein from a wild type AAV serotype to the corresponding AAV9 sequence (SEQ ID NO: 8, SEQ ID NO: 9, SEQ ID NO: 10, SEQ ID NO: 11, SEQ ID NO: 12, SEQ ID NO: 13, SEQ ID NO: 14, or SEQ ID NO: 144). The background AAV vector can be AAV2, AAV4, AAV5, AAV6, AAV7, or AAV8. In one particular example, the wild type AAV vector is AAV1 (with a capsid protein of SEQ ID NO: 15) and the capsid protein comprises one or more of the following amino acid substitution mutations SEQ ID NO: 1→SEQ ID NO: 8, SEQ ID NO: 2→SEQ ID NO: 9, SEQ ID NO: 3→SEQ ID NO: 10, SEQ ID NO: 4→SEQ ID NO: 11, SEQ ID NO: 5→SEQ ID NO: 12, SEQ ID NO: 6→SEQ ID NO: 13, SEQ ID NO: 7→SEQ ID NO: 14; or SEQ ID NO: 143→SEQ ID NO: 144. One of skill in the art can recognize the corresponding sequences in any other AAV serotype and make the corresponding mutations.

The term "AAV vector" as used herein means any vector that comprises or derives from components of AAV and is suitable to infect mammalian cells, including human cells, of any of a number of tissue types, such as brain, heart, lung, skeletal muscle, liver, kidney, spleen, or pancreas, whether in vitro or in vivo. The term "AAV vector" may be used to refer to an AAV type viral particle (or virion) comprising at least a nucleic acid molecule encoding a protein of interest.

Additionally, the AAVs disclosed herein may be derived from various serotypes, including combinations of serotypes (e.g., "pseudotyped" AAV) or from various genomes (e.g., single-stranded or self-complementary). In particular embodiments, the AAV vectors disclosed herein may comprise desired proteins or protein variants. A "variant" as used herein, refers to an amino acid sequence that is altered by one or more amino acids. The variant may have "conservative" changes, wherein a substituted amino acid has similar structural or chemical properties, e.g., replacement of leucine with isoleucine. More rarely, a variant may have "nonconservative" changes, e.g., replacement of a glycine with a tryptophan. Analogous minor variations may also include amino acid deletions or insertions, or both. In certain embodiments, the AAV vectors disclosed herein may comprise a protein that differs by one or more amino acids from SEQ ID NO: 15, SEQ ID NO: 145 or SEQ ID NO: 146. Any of the proteins described herein—even those comprising specified mutations—can be mutated by one or more amino acids relative to the protein described herein, provided that the mutated protein has the same or a similar phenotype to the protein described herein (e.g., as the result of a conservative mutation). One of skill in the art in light of this disclosure can create and test such mutated proteins for phenotype.

Nucleotide sequences, such as polynucleotides, encoding the proteins of the present disclosure are provided herein. The nucleotides of the present disclosure can be composed of either RNA or DNA. The disclosure also encompasses those polynucleotides that are complementary in sequence to the polynucleotides disclosed herein.

Because of the degeneracy of the genetic code, a variety of different polynucleotide sequences can encode the proteins of the present disclosure. In addition, it is well within the skill of a person trained in the art to create alternative polynucleotide sequences encoding the same, or essentially the same, proteins disclosed herein. These variant or alternative polynucleotide sequences are within the scope of the current disclosure. As used herein, references to "essentially the same" sequence refers to sequences which encode amino acid substitutions, deletions, additions, or insertions which do not eliminate the detectability of the polypeptide encoded by the polynucleotides of the present disclosure.

The current disclosure also includes variants of the polynucleotides and polypeptides disclosed herein. Variant sequences include those sequences wherein one or more peptides or nucleotides of the sequence have been substituted, deleted, and/or inserted.

Polynucleotide and polypeptide sequences of the current disclosure can also be defined in terms of particular identity and/or similarity with certain polynucleotides and polypeptides described herein. The sequence identity will typically be greater than 60%, preferably greater than 75%, more preferably greater than 80%, even more preferably greater than 90%, and can be greater than 95%. The identity and/or similarity of a sequence can be 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identical as compared to a sequence disclosed herein. Unless otherwise specified, as used herein percent sequence identity and/or similarity of two sequences can be determined using the algorithm of Karlin and Altschul (1990), modified as in Karlin and Altschul (1993). Such an algorithm is incorporated into the NBLAST and XBLAST programs of Altschul et al. (1990). BLAST searches can be performed with the NBLAST program, score=100, wordlength=12, to obtain sequences with the desired percent sequence identity. To obtain gapped alignments for comparison purposes, Gapped BLAST can be used as described in Altschul et al. (1997). When utilizing BLAST and Gapped BLAST programs, the default parameters of the respective programs (NBLAST and XBLAST) can be used.

Methods of producing AAV vectors as disclosed herein are well known in the art, including methods, for example, of using packaging cells, auxiliary viruses or plasmids, and/or baculovirus systems (see, e.g., Samulski et al., *J. Virology* 63, 3822 (1989); Xiao et al., *J. Virology* 72, 2224 (1998); Inoue et al., *J. Virology* 72, 7024 (1998); WO1998/022607; and WO2005/072364).

Methods of producing pseudotyped AAV vectors are also known (see, e.g., WO00/28004), as well as various modifications or formulations of AAV vectors, to reduce their immunogenicity upon in vivo administration (see, e.g., WO01/23001; WO00/73316; WO04/112727; WO05/005610; and WO99/06562). In some embodiments, AAV vectors may be prepared or derived from various serotypes of AAVs which may be mixed together or mixed with other types of viruses to produce chimeric (e.g., pseudotyped) AAV viruses.

In particular embodiments, the AAV vector may be a human serotype AAV vector. In such embodiments, a human AAV may be derived from any known serotype, e.g., from any one of serotypes 1-11, for instance from AAV1, AAV2, AAV4, AAV6, or AAV9. One specific, non-limiting example of such an AAV vector may include a vector comprising a nucleic acid molecule comprising an ITR and packaging sequence, operatively linked to a nucleic acid encoding an expression cassette for a protein of interest, and a nucleic acid encoding a protein of interest in an AAV9-derived capsid that differs from SEQ ID NO: 1 or SEQ ID NO: 4 by one or more amino acids.

The AAV vectors disclosed herein may include a nucleic acid encoding a protein of interest. In various embodiments, the nucleic acid also may include one or more regulatory sequences allowing expression and, in some embodiments, secretion of the protein of interest, such as e.g., a promoter, enhancer, polyadenylation signal, an internal ribosome entry site (IRES), a sequence encoding a protein transduction domain (PTD), and the like. Thus, in some embodiments, the nucleic acid may comprise a promoter region operably linked to the coding sequence to cause or improve expression of the protein of interest in infected cells. Such a promoter may be ubiquitous, cell- or tissue-specific, strong, weak, regulated, chimeric, etc., for example to allow efficient and stable production of the protein in the infected tissue. The promoter may be homologous to the encoded protein, or heterologous, although generally promoters of use in the disclosed methods are functional in human cells.

Examples of regulated promoters include, without limitation, Tet on/off element-containing promoters, rapamycin-inducible promoters, tamoxifen-inducible promoters, and metallothionein promoters. Other promoters that may be used include promoters that are tissue specific for tissues such as kidney, spleen, and pancreas. Examples of ubiquitous promoters include viral promoters, particularly the CMV promoter, the RSV promoter, the SV40 promoter, etc., and cellular promoters such as the PGK (phosphoglycerate kinase) promoter and the β-actin promoter.

In some embodiments of the AAV vectors disclosed herein, one or more feedback elements may be used to dampen over-expression of the protein of interest. For example, some embodiments of the AAV vectors may include one or more siRNA sequences that would target the exogenous transcript. In other embodiments, the AAV vector may include one or more additional promoters that may be recognized by inhibitory transcription factors. In various embodiments, the AAV vectors disclosed herein may comprise a construct that may create a homoeostatic feedback loop that may maintain expression levels of the protein of interest at a physiological level.

In various embodiments, the AAV vectors disclosed herein can comprise a nucleic acid that may include a leader sequence allowing secretion of the encoded protein. In some embodiments, fusion of the transgene of interest with a sequence encoding a secretion signal peptide (usually located at the N-terminal of secreted polypeptides) may allow the production of the therapeutic protein in a form that can be secreted from the transduced cell. Examples of such signal peptides include the albumin, the β-glucuronidase, the alkaline protease or the fibronectin secretory signal peptides.

As described herein, effective and long term expression of therapeutic proteins of interest in brain, heart, lung, skeletal muscle, kidney, spleen, or pancreas can be achieved with non-invasive techniques, through peripheral administration of certain AAV vectors, such as a non-AAV9 vector with AAV9 sequences. Such peripheral administration may include any administration route that does not necessitate direct injection into brain, heart, lung, skeletal muscle, kidney, spleen, or pancreas. More particularly, peripheral administration may include systemic injections, such as intramuscular, intravascular (such as intravenous) intraperitoneal, intra-arterial, or subcutaneous injections. In some embodiments, peripheral administration also may include oral administration (see, for instance, WO96/40954), delivery using implants, (see, for instance, WO01/91803), or administration by instillation through the respiratory system, e.g., using sprays, aerosols or any other appropriate formulations.

In various embodiments, the desired doses of the AAV vectors may be easily adapted by the skilled artisan, e.g., depending on the disease condition, the subject, the treatment schedule, etc. In some embodiments, from 105 to 1012 viral genomes are administered per dose, for example, from 106 to 1011, from 107 to 1011, or from 108 to 1011. In other embodiments, exemplary doses for achieving therapeutic effects may include virus titers of at least about 105, 106, 107, 108, 109, 1010 or 1011 viral genomes or more. Virus titer may also be expressed in terms of transducing units, which may be readily calculated by those of skill in the art.

In various embodiments, the AAV vectors disclosed herein may be administered in any suitable form, for instance, either as a liquid solution or suspension, as a solid form suitable for solution or suspension in liquid prior to injection, as a gel or as an emulsion. The vectors may be formulated with any appropriate and pharmaceutically acceptable excipient, carrier, adjuvant, diluent, etc. For instance, for injection, a suitable carrier or diluent may be an isotonic solution, a buffer, sterile and pyrogen-free water, or, for instance, a sterile and pyrogen-free phosphate-buffered saline solution. For inhalation, the carrier may be in particulate form.

The vectors may be administered in a "therapeutically-effective" amount, e.g., an amount that is sufficient to alleviate (e.g., decrease, reduce) at least one of the symptoms associated with a disease state, or to provide improvement in the condition of the subject. In some embodiments, repeated administrations may be performed, for instance using the same or a different peripheral administration route and/or the same vector or a distinct vector.

To better understand AAV capsid biology, a novel comprehensive high-throughput reverse genetics method was established that integrates DNA barcoding and next generation sequencing technologies. This approach has been termed "AAV Barcode-Seq". DNA-barcoded AAV capsid libraries with defined capsid mutations are generated and amino acid sequence-AAV capsid phenotype relationship data is collected in vitro, ex vivo and in vivo. A number of amino acids that play important roles in capsid assembly, receptor binding, tropism, blood clearance rates and antibody recognition have been identified (Adachi K et al., *Nat Commun* 5, 3075 (2014); WO 2013-159036; and WO 2013-170078, all of which are incorporated by reference herein). Disclosed herein is a more advanced approach that uses DNA/RNA-barcoded AAV libraries. In this new approach, DNA barcodes are expressed as RNA barcodes under the control of the human U6 snRNA RNA polymerase III promoter. By analyzing the quantity of expressed RNA barcodes by reverse transcription (RT)-PCR, viral gene expression can be quantified. Such expression is important for assessment of AAV vector transduction (i.e., gene delivery resulting in vector genome expression) because viral genome DNA and viral genome transcripts can be discordant.

In earlier work, pharmacokinetic profiles as well as in vivo transduction efficiency of various AAV serotypes and capsid-modified variants and mutants administered intravenously in mice were established (Kotchey N M et al., Mol Ther 19, 1079-1089 (2011); incorporated by reference herein). Rapid clearance of exogenous agents from the bloodstream primarily by Kupffer cells in the liver has been a major hurdle in systemic treatments with such agents. This is particularly the case with adenoviral vectors and cationic non-viral vectors (Alemany R et al., J Gen Virol 81, 2605-2609; 2000; Fenske D B et al., Curr Opin Mol Ther 3, 153-158 (2001); Li S D and Huang L, Gene Ther 13, 1313-1319 (2006); Manickan E et al., Molt her 13, 108-117; 2006; Schagen F H et al., Hum Gene Ther 19, 783-794 (2008); Shayakhmetov D M et al., J Viorl 78, 5368-5381 (2004); Tao N et al., Mol Ther 3, 28-35 (2001); Xu Z L et al., Adv Drug Deliv Rev 57, 781-802 (2005); all of which are incorporated by reference herein.

Although comprehensive pharmacokinetic study is generally an important step in the development of new drugs, blood clearance of rAAV vectors had been largely ignored. In this regard, disclosed herein are data on the pharmacokinetics of rAAV vectors that have shed new light in the mechanisms underlying the wide-spread robust in vivo transduction that is achievable by intravenous injection of AAV9 vectors. AAV9 vectors exhibit a distinctively slow blood clearance and remain fully infectious in the bloodstream. This persistence in the blood plays a pivotal role in the in vivo robustness of AAV9-mediated transduction in non-hepatic tissues. That said, a majority of AAV serotypes (such as AAV1) and mutants thereof show rapid blood clearance.

To further understand the mechanisms for the AAV9's distinctively slowed blood clearance, disclosed herein are recombinantly produced capsids in which a portion of the AAV1 capsid protein is replaced with a corresponding portion from the AAV9 capsid. In particular, AAV1 and AAV9 are serotypes showing fast and slow blood clearance following intravenous injection into mice, respectively. Therefore, assessment of blood clearance of AAV1 capsid mutants carrying a portion of the AAV9 capsid amino acid sequence provides an opportunity to identify AAV9 capsid amino acid motifs that potentially delay blood clearance. For example, an AAV1 mutant capsid in which the AAV1 capsid protein segment between amino acid positions from 455 to 568 is replaced with the AAV9 capsid protein segment between amino acid positions from 456 to 568, shows substantially delayed blood clearance comparable to that of AAV9, although this mutant exhibits significantly impaired infectivity. This observation suggested that the 113 amino acid-long AAV9 capsid protein segment between amino acid positions from 456 to 568 contain amino acids that are responsible for slowing the blood clearance, but did not generate an infectious AAV (Kotchey N M et al. 2011 supra).

Disclosed herein are a set of AAV1 mutants, engineered to express AAV9 capsid amino acids. These mutants exhibit enhanced ability to transduce tissues, particularly the brain, avoid the liver, and maintain persistence in blood following intravenous vector administration.

Viral Capsid Mutants

Viral capsid amino acid modifications that confer new phenotypes of recombinant adeno-associated virus (rAAV) vectors are described. Such phenotypes include prolonged vector circulation half-life, enhanced ability to transduce one or more specific tissues, and liver de-targeting. Such modifications have been generating using the AAV Barcode-Seq approach that uses DNA/RNA-barcoded AAV libraries. The original AAV Barcode-Seq method has been described in our publication (Adachi K et al., *Nat Commun* 5, 3075 (2014); US 2015/0126588, and WO 2013/159036; all of which are incorporated by reference herein.)

The method described in the above references assesses viral genome quantity in tissues using a combination of DNA barcoding and Illumina barcode-sequencing. However, using the method described in the above references, DNA barcodes are not transcribed into RNA. Disclosed herein is a method that also allows the assessment of viral genome expression through RNA barcoding. The disclosed method therefore allows the identification of AAV capsid amino acids that are responsible for extended AAV vector circulation half-life, AAV capsid amino acids important for enhancing the ability to transduce various tissues including the brain, heart, lung, liver, kidney, pancreas, testis, skeletal muscle and adipose tissue, and AAV capsid amino acids important for de-targeting the liver. AAV mutant vectors that acquire these new phenotypes using AAV1 capsids as a platform of capsid modification are described. This same approach can be applied to other serotypes to create novel AAV capsids with a prolonged half-life, enhanced ability to transduce tissues, and avoidance of the liver.

AAV serotype 1 (AAV1) capsid mutants where a set of amino acids is changed from the native AAV1 amino acids to those of AAV serotype 9. As described in the examples below, 7 segments of AAV capsid protein within the amino acid position 455-568 (the positions are based on the AAV1 capsid sequence) are disclosed:

```
                                        SEQ ID NO: 1
455-SAQNKDLL-462

                                        SEQ ID NO: 2
465-RGSPAGMS-472

                                        SEQ ID NO: 3
491-KTKTD-495

                                        SEQ ID NO: 4
500-NFTWT-504

                                        SEQ ID NO: 5
508-KYNLNGRESII-518

                                        SEQ ID NO: 6
529-DDEDKFFPMSGVM-541

                                        SEQ ID NO: 7
546-ESAGASNTALDNVMITDEEEIKA-568
```

The corresponding AAV9 sequences are:

```
                                        SEQ ID NO: 8
456-QNQQTLK-462

                                        SEQ ID NO: 9
465-VAGPSNMA-472

                                       SEQ ID NO: 10
491-TTVTQ-495

                                       SEQ ID NO: 11
500-EFAWP-504

                                       SEQ ID NO: 12
508-SWALNGRNSLM-518

                                       SEQ ID NO: 13
529-EGEDRFFPLSGSL-541

                                       SEQ ID NO: 14
546-QGTGRDNVDADKVMITNEEEIKT-586
```

The following amino acid substitutions are therefore made to convert the AAV1 capsid to that of AAV9 are as follows:

```
SEQ ID NO: 1→SEQ ID NO: 8 =
S455Q/A456N/N458/K459Q/D460T/L462K
(6 mutations)

SEQ ID NO: 2→SEQ ID NO: 9 =
R465V/G466A/S467G/A469S/G470N/S472A
(6 mutations)

SEQ ID NO: 3→SEQ ID NO: 10 =
K491T/K493V/D495Q (3 mutations)

SEQ ID NO: 4→SEQ ID NO: 11 =
N500E/T502A/T504P (3 mutations)

SEQ ID NO: 5→SEQ ID NO: 12 =
K508S/Y509W/N510A/E515N/I517L/I518M
(6 mutations)

SEQ ID NO: 6→SEQ ID NO: 13 =
D529E/D530G/K533R/M537L/V540S/M541L
(6 mutations)

SEQ ID NO: 7→SEQ ID NO: 14 =
E546Q/S547G/A548T/A550R/S551D/T553V/A554D/L555A/
N557K/D562N/A568T (11 mutations).
```

The disclosed capsid proteins were generated by substituting 3 to 11 amino acids of the AAV1 capsid with those of the AAV9 capsid in each segment. A total of the 127 AAV1 mutants were created. Blood clearance rates of the wild-type AAV1, all 127 AAV1 mutants and AAV9 following intravenous injection into mice were determined using the AAV Barcode-Seq. In addition, vector genome DNA biodistribution and transduction were determined in brain, heart, lung, liver, kidney, spleen, intestine, pancreas, testis, skeletal muscle and adipose tissue 6 weeks post-injection. Double alanine (AA) scanning of the entire AAV9 capsid of 736 amino acids was used to identify AAV9 capsid amino acids important for the delayed blood clearance. Vectors comprising capsids with combinations of amino acids important for blood clearance and in vivo transduction and that show prolonged half-lives and enhanced transduction in the brain or other tissues while detargeting the liver are described.

AAV1 capsid mutants with different combinations of these AAV1 and AAV9 segments show new phenotypes summarized in Table 1. The new phenotypes include (1) continued presence in blood circulation at 24 hours post-injection; (2) continued presence in blood circulation at 72 hours post-injection; (3) enhanced ability to transduce the brain at a rate 4× greater than non-mutant AAV1 (SEQ ID NO: 15); (4) enhanced ability to transduce the heart, lung, liver, kidney, pancreas, testis, skeletal muscle and/or adipose tissues at a rate 4× greater than non-mutant AAV1 (SEQ ID NO: 15); and (5) de-targeting the liver at a rate of 0.1× relative to non-mutant AAV1 (SEQ ID NO: 15).

TABLE 1

Phenotypes of AAV1→AAV9 capsid mutants

| SEQ ID NO: | >24 hours in blood | >72 hours in blood | Liver detargeting | Enhanced brain transduction | Enhanced transduction to other tissues |
|---|---|---|---|---|---|
| 16 | | | | | Pancreas |
| 17 | | | X | | |
| 18 | | | X | | |
| 19 | | | | | |
| 20 | | | X | | |
| 21 | | | X | | |
| 22 | | | X | | |
| 23 | X | X | | X | Liver, pancreas, skeletal muscle, visceral fat |
| 24 | | | | X | Lung, liver, visceral fat |
| 25 | X | | X | | |
| 26 | X | | X | X | |
| 27 | X | X | | X | Heart, liver, kidney, pancreas, testis, skeletal muscle, visceral fat |
| 28 | X | X | | X | Heart, pancreas, visceral fat |
| 29 | X | | X | | |
| 30 | X | | X | X | |
| 31 | | | X | | |
| 32 | | | X | | |
| 33 | | | X | | |
| 34 | | | X | | |
| 35 | | | X | | |
| 36 | | | X | | |
| 37 | | | X | | |
| 38 | | | X | | |
| 39 | X | | X | | |
| 40 | X | | X | X | |
| 41 | X | | X | | |
| 42 | X | | X | | |
| 43 | X | | X | | |
| 44 | X | | X | X | |
| 45 | X | | X | | |

TABLE 1-continued

Phenotypes of AAV1→AAV9 capsid mutants

| SEQ ID NO: | >24 hours in blood | >72 hours in blood | Liver detargeting | Enhanced brain transduction | Enhanced transduction to other tissues |
|---|---|---|---|---|---|
| 46 | X | | X | | |
| 47 | | | | | |
| 48 | | | | | Liver |
| 49 | | | X | | |
| 50 | X | | X | X | |
| 51 | | | | | |
| 52 | | | | | |
| 53 | | | X | | |
| 54 | | | X | X | |
| 55 | X | X | | X | Liver, visceral fat, |
| 56 | | | | | Visceral fat |
| 57 | X | | X | | |
| 58 | X | | X | | |
| 59 | | | | | Liver, visceral fat |
| 60 | X | | | X | Visceral fat |
| 61 | X | | X | | |
| 62 | X | | X | | |
| 63 | | | X | | |
| 64 | | | X | | |
| 65 | X | | X | | |
| 66 | X | | X | | |
| 67 | | | X | | |
| 68 | | | X | | |
| 69 | | | X | | |
| 70 | | | X | | |
| 71 | | | | X | Visceral fat |
| 72 | X | | X | | |
| 73 | X | | X | | |
| 74 | X | | X | | |
| 75 | X | | X | | |
| 76 | X | | X | | |
| 77 | X | | X | | |
| 78 | X | | X | | |
| 79 | | | X | | |
| 80 | | | X | | |
| 81 | | | X | | |
| 82 | | | X | | |
| 83 | | | X | | |
| 84 | | | X | | |
| 85 | | | X | | |
| 86 | | | X | | |
| 87 | X | X | | | Lung, liver, kidney, pancreas, skeletal muscle, visceral fat |
| 88 | | | | X | Lung, liver, visceral fat |
| 89 | X | | X | X | |
| 90 | X | | | X | Heart |
| 91 | X | X | | | Liver, visceral fat |
| 92 | X | X | | X | Heart, liver, visceral fat |
| 93 | X | | X | | |
| 94 | X | | X | | |
| 95 | | | X | | |
| 96 | | | X | | |
| 97 | | | X | | |
| 98 | | | X | | |
| 99 | | | X | | |
| 100 | | | X | | |
| 101 | | | X | | |
| 102 | | | X | | |
| 103 | X | | | | |
| 104 | X | | | X | |
| 105 | X | | X | X | |
| 106 | X | | X | | |
| 107 | X | X | X | | |
| 108 | X | | X | X | |
| 109 | X | | X | | |

TABLE 1-continued

Phenotypes of AAV1→AAV9 capsid mutants

| SEQ ID NO: | >24 hours in blood | >72 hours in blood | Liver detargeting | Enhanced brain transduction | Enhanced transduction to other tissues |
|---|---|---|---|---|---|
| 110 | X | | X | | |
| 111 | | | | | Liver |
| 112 | | | | | |
| 113 | | | X | | |
| 114 | X | | | X | |
| 115 | | | | | |
| 116 | | | | | |
| 117 | | | X | | |
| 118 | X | | X | | |
| 119 | | | | | Liver |
| 120 | | | | X | Lung, liver, visceral fat |
| 121 | X | | X | | |
| 122 | X | | | X | |
| 123 | | X | | | Liver, visceral fat |
| 124 | X | | | X | Heart, liver, visceral fat |
| 125 | X | | X | | |
| 126 | X | | X | X | |
| 127 | | | | | |
| 128 | | | | | |
| 129 | X | | X | | |
| 130 | X | | X | | |
| 131 | | | X | | |
| 132 | | | X | | |
| 133 | | | X | | |
| 134 | | | X | | |
| 135 | | | X | | |
| 136 | X | | X | | |
| 137 | X | | X | | |
| 138 | X | | X | | |
| 139 | X | | X | | |
| 140 | X | | X | X | |
| 141 | X | | X | | |
| 142 | X | | X | | |

TABLE 2

Phenotypes of AAV9 double alanine mutants and blood clearance.

| Amino acid substitutions | Relative blood concentration at 24 h post-injection* (AAV9 = 1.00) | Relative blood concentration at 72 h post-injection* (AAV9 = 1.00) |
|---|---|---|
| D4A/G5A | 1.15 | 1.16 |
| W10A/L11A | 1.42 | 1.34 |
| E12A/D13A | 0.94 | 0.97 |
| N14A/L15A | 1.06 | 1.09 |
| S16A/E17A | 0.92 | 1.04 |
| G18A/I19A | 0.96 | 0.97 |
| R20A/E21A | 1.08 | 1.05 |
| W22A/W23A | 1.35 | 1.19 |
| L25A | 1.10 | 1.11 |
| K26A/P27A | 1.07 | 0.99 |
| G28A | 1.22 | 1.11 |
| P30A/Q31A | 1.18 | 1.12 |
| P32A/K33A | 1.24 | 1.25 |
| N35A | 1.00 | 1.02 |
| Q36A/Q37A | 1.29 | 1.21 |
| H38A/Q39A | 0.93 | 0.99 |
| D40A/N41A | 0.96 | 1.10 |
| R43A | 0.91 | 1.01 |
| G44A/L45A | 1.02 | 1.05 |
| V46A/L47A | 0.92 | 1.01 |
| P48A/G49A | 1.11 | 1.10 |
| Y50A/K51A | 1.06 | 1.02 |

TABLE 2-continued

Phenotypes of AAV9 double alanine mutants and blood clearance.

| Amino acid substitutions | Relative blood concentration at 24 h post-injection* (AAV9 = 1.00) | Relative blood concentration at 72 h post-injection* (AAV9 = 1.00) |
|---|---|---|
| Y52A/L53A | 1.00 | 1.01 |
| G54A/P55A | 0.98 | 1.00 |
| G56A/N57A | 1.01 | 1.00 |
| G58A/L59A | 1.01 | 1.00 |
| D60A/K61A | 0.98 | 1.06 |
| G62A/E63A | 0.92 | 1.03 |
| P64A/V65A | 1.00 | 0.96 |
| N66A | 1.03 | 1.02 |
| D69A | 0.96 | 1.08 |
| | 0.93 | 0.98 |
| L73A | 0.94 | 1.05 |
| E74A/H75A | 0.99 | 1.01 |
| D76A/K77A | 1.05 | 0.97 |
| Y79A | 0.93 | 0.95 |
| D80A/Q81A | 0.94 | 1.02 |
| Q82A/L83A | 1.00 | 0.99 |
| K84A | 0.94 | 0.97 |
| G86A/D87A | 0.95 | 1.05 |
| N88A/P89A | 1.03 | 1.07 |
| Y90A/L91A | 1.08 | 1.04 |
| K92A/Y93A | 1.00 | 1.04 |
| N94A/H95A | 0.92 | 0.98 |
| D97A | 0.90 | 0.93 |
| E99A | 0.97 | 1.00 |
| F100A/Q101A | 0.90 | 1.01 |
| E102A/R103A | 1.02 | 1.02 |
| L104A/K105A | 1.11 | 1.30 |
| E106A/D107A | 1.20 | 1.16 |
| T108A/S109A | 1.02 | 1.08 |
| F110A/G111A | 1.00 | 1.08 |
| G112A/N113A | 0.92 | 0.93 |
| L114A/G115A | 0.92 | 0.99 |
| R116A | 0.95 | 1.03 |
| V118A/F119A | 0.93 | 1.03 |
| Q120A | 1.08 | 1.11 |
| K122A/K123A | 1.12 | 1.08 |
| R124A/L125A | 0.99 | 1.02 |
| L126A/E127A | 0.89 | 1.00 |
| P128A/L129A | 0.98 | 1.06 |
| G130A/L131A | 0.96 | 0.96 |
| V132A/E133A | 0.90 | 1.00 |
| E134A | 0.96 | 1.01 |
| K137A | 0.87 | 1.00 |
| T138A | 0.96 | 0.99 |
| P140A/G141A | 1.07 | 0.98 |
| K142A/K143A | 1.04 | 1.02 |
| R144A/P145A | 0.95 | 0.96 |
| V146A/E147A | 0.98 | 1.02 |
| Q148A/S149A | 0.95 | 0.87 |
| P150A/Q151A | 1.02 | 0.93 |
| E152A/P153A | 0.89 | 0.98 |
| D154A/S155A | 0.96 | 1.08 |
| S156A | 0.92 | 1.06 |
| G158A/I159A | 1.02 | 1.00 |
| G160A/K161A | 0.89 | 1.01 |
| S162A/G163A | 0.97 | 1.05 |
| Q165A | 0.93 | 0.96 |
| P166A | 1.10 | 0.94 |
| K168A/K169A | 1.04 | 1.09 |
| R170A/L171A | 0.93 | 1.08 |
| N172A/F173A | 0.93 | 1.05 |
| G174A/Q175A | 0.97 | 1.10 |
| D178A/T179A | 0.87 | 0.96 |
| E180A/S181A | 0.91 | 1.00 |
| V182A/P183A | 0.90 | 1.10 |
| D184A/P185A | 0.90 | 1.03 |
| Q186A/P187A | 0.89 | 0.96 |
| I188A/G189A | 1.00 | 1.00 |
| E190A/P191A | 0.88 | 0.87 |
| P192A | 0.89 | 1.00 |
| P195A | 0.93 | 1.09 |

TABLE 2-continued

Phenotypes of AAV9 double alanine mutants and blood clearance.

| Amino acid substitutions | Relative blood concentration at 24 h post-injection* (AAV9 = 1.00) | Relative blood concentration at 72 h post-injection* (AAV9 = 1.00) |
|---|---|---|
| S196A/G197A | 0.93 | 0.97 |
| V198A/G199A | 0.93 | 0.99 |
| S200A/L201A | 0.99 | 0.95 |
| S205A | 1.02 | 0.88 |
| G206A/G207A | 0.91 | 1.06 |
| G208A | 0.98 | 0.99 |
| P210A/V211A | 1.02 | 1.12 |
| D213A | 1.11 | 1.16 |
| N214A/N215A | 1.24 | 1.10 |
| E216A/G217A | 1.38 | 1.22 |
| D219A | 1.25 | 1.31 |
| G222A/S223A | 2.96 | 1.63 |
| G226A/N227A | 2.04 | 1.02 |
| T242A/S243A | 0.82 | 1.13 |
| L249A | 1.22 | 1.21 |
| P250A/T251A | 1.46 | 1.21 |
| N254A/H255A | 2.21 | 0.99 |
| K258A/Q259A | 4.35 | 0.13 |
| N262A/S263A | 5.16 | 0.03 |
| T264A/S265A | 5.03 | 0.03 |
| G266A/G267A | 0.65 | 0.01 |
| S268A/S269A | 5.03 | 0.03 |
| N270A/D271A | 4.36 | 0.02 |
| N272A | 4.49 | 0.14 |
| T326A/D327A | 1.11 | 1.19 |
| N328A/N329A | 0.96 | 1.02 |
| G330A/V331A | 1.07 | 1.20 |
| I334A | 2.21 | 1.52 |
| L338A/T339A | 1.71 | 0.76 |
| S348A/D349A | 0.88 | 1.01 |

EXAMPLES

The following examples are for illustration only. In light of this disclosure, those of skill in the art will recognize that variations of these examples and other embodiments of the disclosed subject matter are enabled without undue experimentation.

Example 1 dsAAV-U6-VBCLib

The AAV Barcode-Seq method described in Adachi K et al. 2014 supra is a powerful approach to characterize various biological phenotypes of multiple different AAV strains (serotypes and mutants) in a high-throughput manner. However, this method has important limitations. The method quantifies viral DNA genome copy numbers in samples with no capability of quantifying transgene expression, an important readout for gene delivery. In addition, the DNA-barcoded AAV genomes have viral rep and cap genes, which makes it cumbersome to create new DNA-barcoded AAV strains. This is because each new AAV strain needs to be DNA-barcoded by genetic engineering of the viral genome.

To overcome these limitations, a novel universal Barcode-Seq system expressing RNA barcodes is disclosed herein. This is termed AAV DNA/RNA Barcode-Seq. In this system, AAV libraries are produced in which each viral particle contains a DNA genome that is devoid of the rep and cap genes but is transcribed into an RNA barcode unique to its own capsid. The viral genome map is shown in FIG. 1A. The dsAAV-U6-VBCLib vector can be produced by transfecting HEK 293 cells with the following three plasmids, pAAV-U6-VBCLib supplying the viral genome, pHLP-AAVx supplying AAV2 Rep and AAVx Cap proteins (x=serotype or mutant ID), and pHelper supplying adenoviral component necessary for AAV vector production. When capsid gene mutations are introduced within the assembly activating protein (AAP)-VP overlapping open reading frames (ORFs), a plasmid expressing the corresponding AAP protein, pCMV-FLAG-cmAAPx (x=serotype) was also used (Earley L F et al., J Virol 89, 3038-3048 (2015); incorporated by reference herein).

Figure 1B:
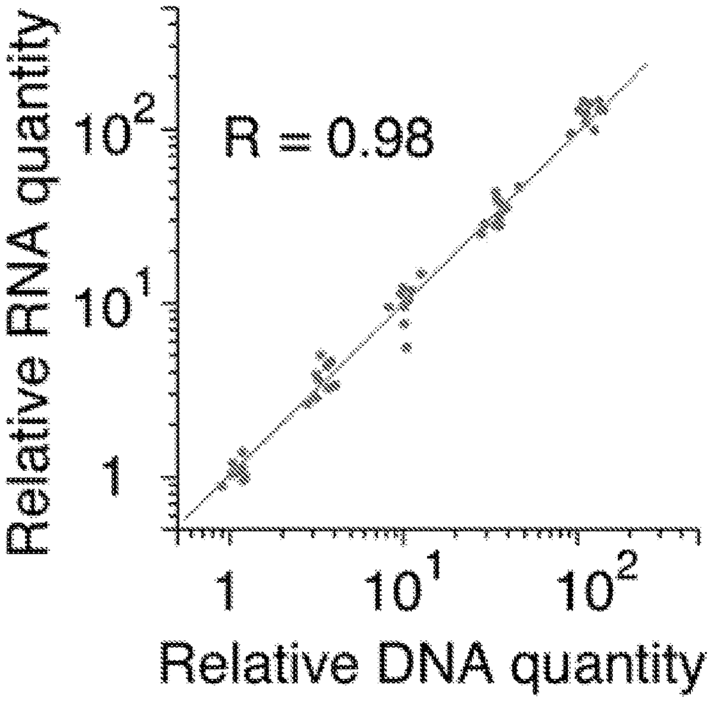
FIG. 1B is a scatter plot showing a linear correlation between relative DNA and RNA quantities determined by AAV DNA/RNA Barcode-Seq. HEK 293 cells were infected with two different AAV libraries containing 25 rAAV2 clones mixed at an equal amount or at approximately 1:3:10:30:100 ratio, and harvested 48 hours post-infection. Each clone was tagged with a clone-specific barcode. Relative DNA and RNA quantifies of each clone in the same HEK 293 cell sample were determined by Illumina barcode sequencing read numbers and plotted.

Two libraries of 25 recombinant AAV2 viral clones mixed at defined ratios were generated and used to infect HEK 293 cells with each library in duplicate. The cells were harvested 48 hours post-infection. In these libraries, each viral clone carried the dsAAV-U6-VBCLib genome expressing RNA containing a pair of clone-specific 12 ribonucleotides transcribed from the corresponding DNA barcode sequences placed downstream of the human U6 snRNA gene promoter (FIG. 1A). Illumina sequencing of DNA-PCR and reverse-transcription (RT)-PCR barcode amplicons from total DNA and RNA extracted from the same library-infected cells showed that viral genome expression could be determined by Barcode-Seq in at least a 2-log dynamic range with a Pearson's correlation coefficient of 0.98 (FIG. 1B).

Example 2

DNA/RNA-Barcoded AAV1.9-xxxxxxx Library

Figure 2:
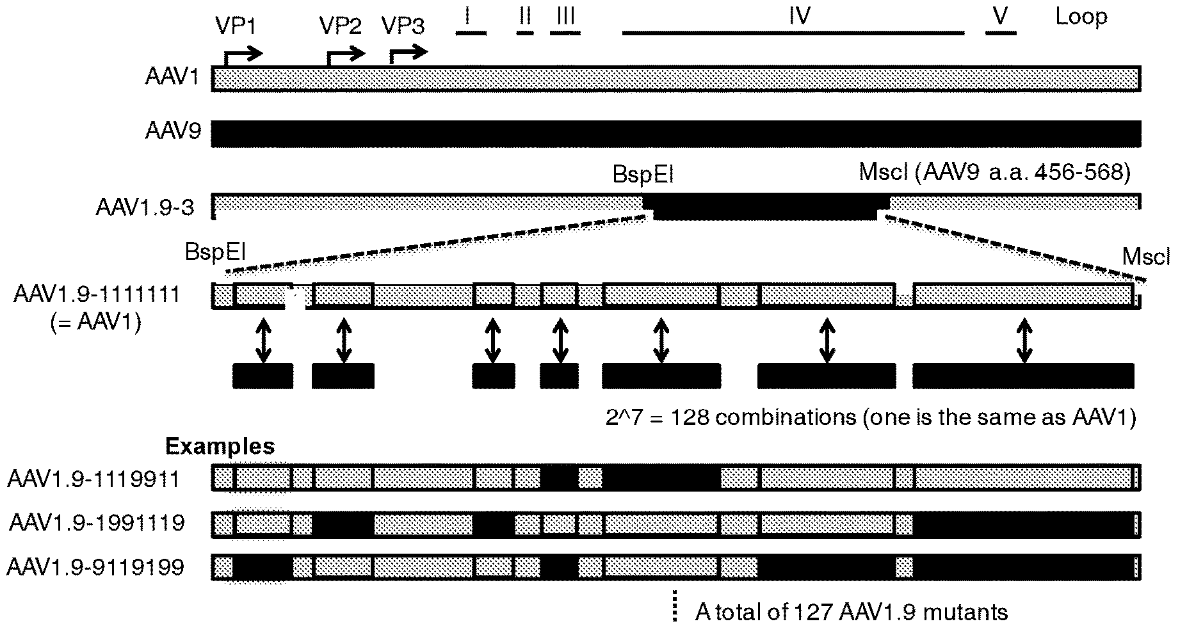
FIG. 2 is a map of AAV1.9-xxxxxxx capsids. The full length of the AAV capsid proteins derived from AAV1 (gray bars) and AAV9 (black bars) are displayed. The AAV1.9-3 capsid shows substantially slowed blood clearance compared to AAV1 and primarily exhibits a non-infectious phenotype.

The AAV1.9-xxxxxxx capsids are the AAV1 capsid mutants in which one or more of the 7 segments derived from the AAV1 capsids (SEQ ID NOs: 1-7) are replaced from those derived from the AAV9 capsids (SEQ ID NOs: 8-14) (FIG. 2). Mutants corresponding to the AAV1.9-xxxxxxx library are listed in SEQ ID NOs: 16-142 with phenotypes listed in Table 1. The DNA/RNA-barcoded AAV1.9-xxxxxxx library used in the study contained the following AAV vectors; dsAAV9-U6-VBCLib (15 clones), dsAAV1-U6-VBCLib (15 clones), dsAAV2R585E-U6-VBCLib (15 clones), and 128 dsAAV1.9-xxxxxxx-U6-VBCLib (2 clones per strain, a total of 256 clones). There were 301 different viral clones in the library and each viral clone in the library carried a pair of viral clone-specific 12-nucleotide-long DNA barcodes that are expressed as RNA barcodes in transduced cells. Therefore, relative amounts of viral genome DNA and transcripts among the all the clones contained in the library could be quantified using AAV DNA/RNA Barcode-Seq.

Figure 3:
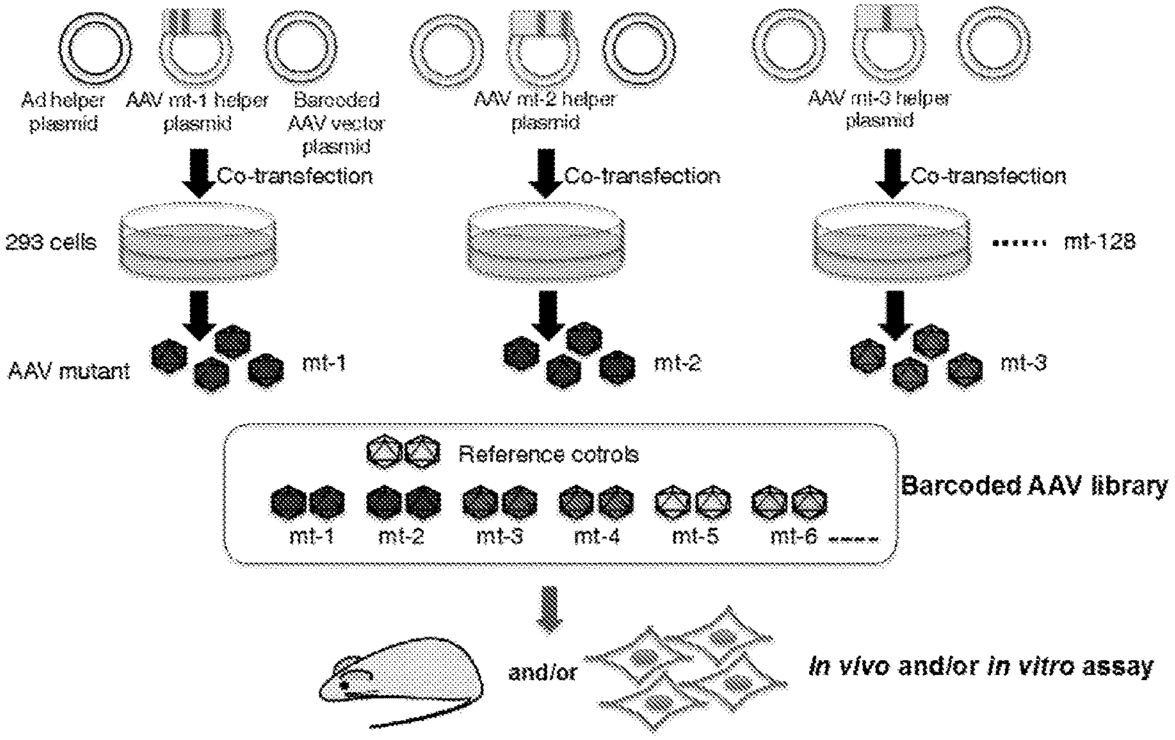
FIG. 3 is an illustration of a three plasmid transfection method used for AAV vector production. The ad helper plasmid provides adenovirus components necessary for AAV vector production, AAV helper plasmids provide AAV2 Rep proteins and AAV capsid proteins (wild-type and mutant), and barcoded AAV vector plasmids provide viral genomes (dsAAV-U6-VBCLib vector genomes) packaged in the virion shell. Each wild-type and mutant AAV vector clone was produced in separate dishes, pooled, purified as one AAV vector preparation, and used for in vitro and in vivo experiments.

The AAV1.9-xxxxxxx virus library was prepared in primarily the same manner as previously describe in Adachi et al. 2014 supra. In brief, each viral clone was produced in HEK 293 cells in a separate 10 cm dish according to the standard adenovirus-free three plasmid transfection method (Veloso A et al., Genome Res 24, 896-905 (2014); incorporated by reference herein) except that viral particles were recovered from both culture medium and cells collected 5 days after transfection (FIG. 3). The viral particle-containing culture media and cells were pooled. The relative quantity of each viral clone in the pool was determined by AAV Barcode-Seq, and the amount of clones mixed into the library was adjusted if necessary. The viral particles derived from a mixture of different viral clones were purified as a single AAV vector preparation by two-rounds of cesium chloride ultracentrifugation.

Example 3

DNA/RNA-Barcoded AAV9-AA Library

As termed herein, AAV9-AA capsids are AAV9 capsid mutants with double alanine (AA) mutations at defined locations. Biological phenotypes of 191 AA mutants that cover the C-terminal half of the AAV9 capsid protein (amino acid positions from 356 to 736) have been characterized and disclosed elsewhere (Adachi et al. 2014 supra). A total of 175 AA mutants that cover the N-terminal half of the AAV9 capsid protein (amino acid positions from 1 to 355) are disclosed herein. Of those, 62 out of the 175 AA mutants either failed to produce virions or produced insufficient virions for downstream phenotypic characterization. A DNA/RNA-barcoded AAV9 AA mutant library containing a total of 256 viral clones representing AAV9 (15 clones), AAV2R585E (15 clones) and 113 AAV9 AA mutants (2 clones per mutant) was generated using the 113 AA mutants that could successfully produce virions at sufficient levels. These were produced and purified (Table 2) as described above except that AAV9 was expressed in HEK 293 cells at the time of vector production.

TABLE 3

DNA/RNA-barcoded AAV virus libraries
Table 3. DNA/RNA-barcoded AAV virus libraries

| | AAV clones contained in the library | | | | |
|---|---|---|---|---|---|
| Library ID | AAV | No. of mutants | No. of clones | Amino acids to be investigated | Total no. of clones |
| 507 | AAV9 | control | 15 | | 256 |
| | AAV2R585E | control | 15 | | |
| | AAV9 double alanine mutants | 113 | 256 (2 each) | 1-355 | |
| 521 | AAV9 | control | 15 | | 301 |
| | AAV2R585E | control | 15 | | |
| | AAV1 | control | 15 | | |
| | AAV1.9-1111111* | wild type | 2 | | |
| | AAV1.9-xxx | 127 | 254 | | |
| 513 | AAV9 | control | 15 | | 178 |
| | AAV2R585E | control | 15 | | |
| | AAV1, 2, 3, 4, 5, 6, 7, 8, 10, 11 | serotype (wide type) | 2 each | | |
| | AAVrh8, 10, 20, 43, AAVhu11, 13, 37, AAVbb2 | new isolates (wide type) | 2 each | | |
| | AAV capsid mutants | 11 | 2 each | | |
| 534 | AAV9 | wild type | 473 | | 473 |
| 535 | AAV9 | wild type | 473 | | 473 |

*AAV1.9-1111111 has the AAV1 wild type capsid and is produced using pHLP-AAV1.9-1111111, an AAV helper plasmid that was created in the same manner as that for other AAV1.9-xxx mutants. pHLP-AAV1.9-1111111 is different from pHLP19-1, our standard AAV1 helper plasmid.

Example 4

AAV DNA/RNA Barcode-Seq

The procedure for the DNA Barcode-Seq is based upon the method described in Adachi et al. 2014 supra. Total DNA was extracted from mouse tissue samples using KingFisher Flex Magnetic Particle Processor and Cell and Tissue DNA Kit (Thermo Scientific). One μg of total DNA was used as a template for the subsequent PCR reactions. The viral genome of each individual AAV clone has a clone-specific set of two viral DNA barcodes (left and right VBCs). The left and right VBCs can be PCR amplified with right and left VBC-specific primer sets, respectively. Each primer is tagged with a sample-specific barcode (SBC) for multiplex Illumina sequencing. In the pharmacokinetics study, VBCs were amplified directly from the blood samples without extracting DNA using the lysis and neutralization buffers that come with Extract-N-Amp Blood PCR Kit (Sigma). A volume of 0.1 μl of whole blood was used. PCR products were then pooled at an equimolar ratio, and subjected to Illumina sequencing using a HiSeq2500.

The procedure for the RNA Barcode-Seq is as follows: Tissue samples were homogenized in 1 ml of Trizol using a Bead Mill 24 homogenizer (ThermoFisher Scientific). A 500 μl of homogenate was used for RNA extraction. The homogenates were mixed with 100 μl of chloroform and centrifuged to separate the upper aqueous phase. Total RNA was extracted from 200 μl of the aqueous phase using a KingFisher Flex Magnetic Particle Processor and Mag-Bind Total RNA 96 Kit (Omega Bio-Tek). Homogenates were further treated with the Ambion TURBO DNA-free Kit (ThermoFisher Scientific) to remove contaminating DNA. A 1 μg sample of DNase-treated RNA was subjected to reverse transcription (RT) using an Ambion RETROscript Reverse Transcription Kit (ThermoFisher Scientific). Each of the left and right RNA VBCs was then amplified using one quarter of the RT products and the same primers that were used for the DNA Barcode-Seq. The subsequent Illumina sequencing and data analysis were performed in the same manner as that for the DNA Barcode-Seq.

Example 5

Illumina Sequencing Data Analysis

Illumina sequencing was done with the HiSeq2500 at Elim Biopharmaceuticals Inc. The raw fastq data were transferred to BioU, a 3-node computational cluster (16 cores per node). Binning of Illumina sequencing reads according to SBCs and VBCs was done using an algorithm implemented in Perl.

Example 6

Validation and Proof-of-Principle of AAV DNA Barcode-Seq

The AAV DNA Barcode-Seq approach was validated in, for example, Adachi et al. 2014 supra. To show the proof-of-principle of the AAV DNA Barcode-Seq method data obtained by traditional methods were compared to those obtained by AAV DNA Barcode-Seq in the context of tissue transduction and pharmacokinetics profiles of various AAV serotypes in mice following intravenous vector administration. The data obtained by either method show concordant results.

Example 7

Validation of RNA Barcode-Seq

Two validation studies using AAV DNA/RNA-barcoded libraries carrying the AAV-U6-VBCLib genome were performed. In the first study, two different DNA/RNA-barcoded AAV2 AAV libraries containing 25 rAAV2 clones mixed at an equal amount (Library A) or at approximately 1:3:10:30:100 ratio (Library B). Each clone was tagged with a clone-specific barcode. HEK 293 cells were infected with the two different AAV libraries separately and harvested 48 hours post-infection. Total DNA and RNA were extracted from Sample A (infected with Library A) and from Sample B (infected with Library B), and subjected to the AAV DNA/RNA Barcode-Seq analysis. In this trial, Sample A served as the reference control and Sample B served as a sample containing transduced AAV genomes at different levels. The relative amount of genomic DNA of each viral clone in Sample B was assessed using DNA Barcode-Seq and the relative amount of RNA barcode transcripts of each viral clone in Sample B was assessed using RNA Barcode-Seq, with Sample A as the reference control. A linear correlation was observed between the relative quantity of viral genome DNA and the relative quantity of viral RNA barcode transcripts with Pearson's coefficient of 0.98 (FIG. 1B). This indicates that an the amount of viral genome DNA is proportional to the amount of viral RNA barcode transcripts and that RNA Barcode-Seq can faithfully quantify relative RNA barcode transcripts in a 2-log range.

In a second experiment, an AAV DNA/RNA-barcoded library containing 473 different AAV9 clones carrying the AAV-U6-VBCLib genome was produced. The viral genomic DNA of each clone contained a clone-specific set of two 12-nucleotide-long DNA barcodes that could be transcribed into RNAs in cells. The ratio of the clones in the library was adjusted so that each clone was included at approximately at the same quantity. Three mice were injected with this library intravenously, and the liver and heart harvested 10 days post-administration. The total DNA and RNA were extracted from each tissue and subjected to the DNA and RNA Barcode-Seq analyses as described above. Another AAV DNA/RNA-barcoded library containing 473 different AAV9 clones carrying the AAV-U6-VBCLib genome was produced independently, and the above-described experiments performed the as a replicated experiment. So, two datasets were produced from two experiments that followed exactly the same experimental scheme but were performed independently (i.e., Experiment No.1 and Experiment No.2).

Figure 4A:
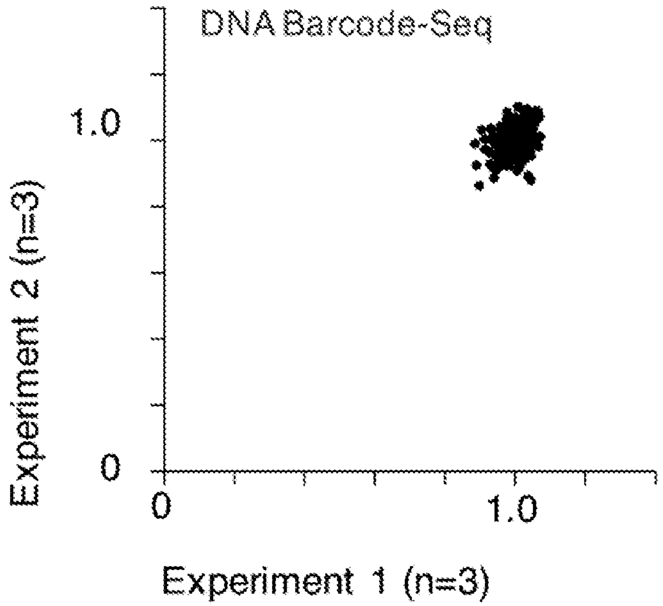
FIG. 4A is a plot showing quantities of viral genome DNA of each AAV clone in the liver determined by the AAV DNA Barcode-Seq. Values are globally normalized to set the average value as 1.0 and plotted. The data were obtained from two independent experiments (Experiment 1, x-axis; Experiment 2, y-axis).
Figure 4B:
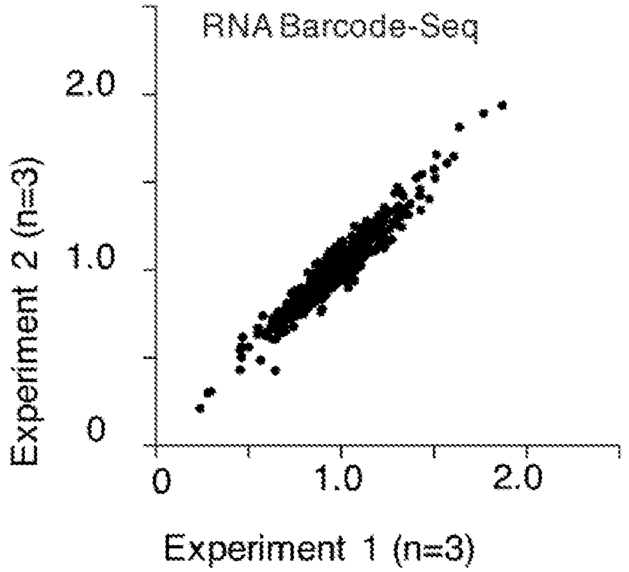
FIG. 4B is a plot showing quantities of RNA barcode transcripts from each AAV clone in the liver determined by the AAV RNA Barcode-Seq. Values are globally normalized to set the average value as 1.0 and plotted. The data were obtained from two independent experiments (Experiment 1, x-axis; Experiment 2, y-axis).
Figure 4C:
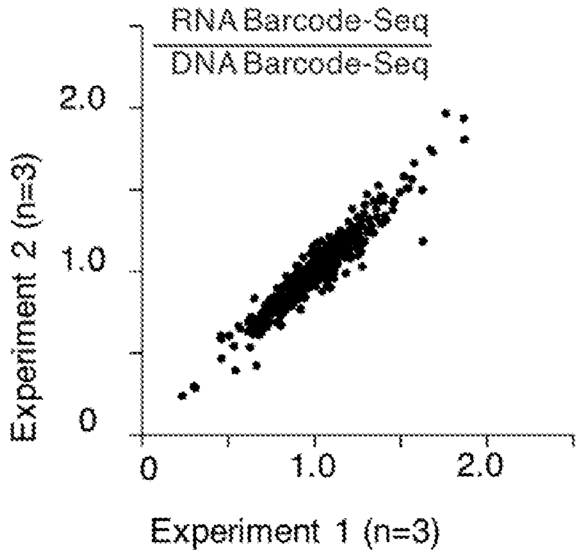
FIG. 4C is a plot showing ratios of the relative quantities of viral RNA barcode transcripts to those of viral genome DNA in each clone obtained from two independent experiments.
Figure 4D:
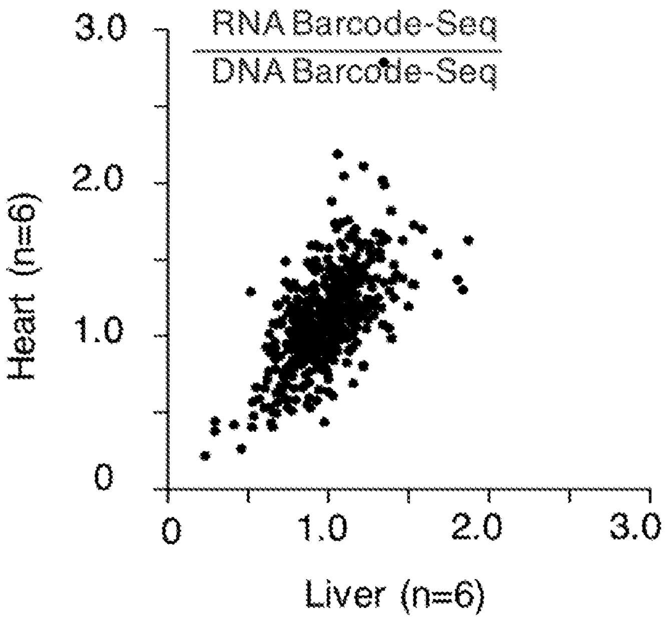
FIG. 4D is a plot showing a comparison of RNA barcode expression profiles between the liver and the heart. Ratios of the relative quantities of viral RNA barcode transcripts to those of viral genome DNA in each clone.

Because all the 473 viral clones had the same AAV9 capsid shell and the AAV vector genomes are effectively the same (except for the barcode region), the ability to deliver viral genomes to the liver and/or the heart was expected the same across all the 473 clones. However, it was observed that when efficiencies of AAV vector-mediated gene transfer to the liver was determined by AAV DNA-Barcode Seq and globally normalized to set the average as 1.0, the coefficients of variation of the liver gene transfer efficiencies were very small, 0.029 and 0.038 for Experiments 1 and 2, respectively (FIG. 4A). In contrast, expression levels of RNA barcodes determined by the RNA Barcode-Seq may vary because the rate of elongation of transcripts is a function of template DNA sequence (Veloso A et al., Genome Res 24, 896-905 (2014); incorporated by reference herein). In fact, the RNA Barcode-Seq analysis of the liver samples revealed that relative transduction efficiencies determined by the relative quantities of RNA barcode transcripts vary between 0.2-1.9 when the average is 1.0 (FIG. 4B). This indicates that there can be up to ~10 fold difference between the least transduced AAV9 clone and the best transduced clone even though the vector genome copy numbers are comparable in the liver for all the clones (FIG. 4A). However, the clone-specific levels of RNA barcode transcripts are reproducible between two independent experiments (FIGS. 4B and 4C). In addition, both the liver and the heart showed very similar DNA/RNA barcode sequence-dependent effects on transcription (FIG. 4D). These observations offer a reasonable strategy to negate the DNA/RNA barcode sequence-dependent effects on the assessment of transduction by RNA Barcode-Seq by employing the "correction factors", which are defined as the ratios of the RNA Barcode-Seq data to the DNA Barcode-Seq data (FIG. 4C). When the "correction factor" for an AAV clone is 0.2, the transduction efficiency of this clone determined by RNA Barcode-Seq is underestimated by a factor of 0.2, and the true transduction efficiency is estimated to be 5 times more than the RNA Barcode-Seq estimate. Of note is that 85% and 97% of the 473 AAV clones exhibit correction factors between 0.7 and 1.3 and between 0.5 and 1.5, respectively; therefore, even if the DNA/RNA barcode sequence-dependent effects on transcription is not taken into account, the transduction efficiency data determined by the RNA Barcode-Seq fairly represent the true transduction efficiencies in most of the AAV clones.

Example 8

Significance of AAV-RNA Barcode-SEQ

The information of the atomic structure of the AAV capsids has significantly advanced our understanding of the AAV capsid structure-function relationships, and accelerated the research on AAV capsid engineering aimed at creating novel AAV capsids with better biological performance or altered tropism. The main strategic paradigm in protein research is to obtain and use protein structural information to identify a potential functional domain(s) and predict its roles, and investigate them by mutagenesis-based functional studies. Structural biology approaches, however, are not often powerful enough in viral capsid research. This is because viral capsid proteins exert their multifunctional roles in their quaternary structure, and they are structurally, functionally and often co-evolutionarily constrained in a manner specific to each viral species. Therefore, it remains very difficult to infer and understand functional roles and significance of each amino acid or a group of amino acids in a region of interest through structural information without complementing functional data obtained by mutagenesis experiments. As for AAV, it has been shown that only one or a few amino acid substitution(s) could significantly change the biological property of the virus capsid in a manner difficult to predict or interpret (Pulicherla N et al., Mol Ther 19, 1070-1078 (2011); Vandenberghe L H et al., Gene Ther 16, 1416-1428 (2009); and Excoffon K J et al., Proc Natl Acad Sci USA 106, 3865-3870 (2009); all of which are incorporated by reference herein).

In this context, the AAV Barcode-Seq has opened a new avenue to AAV capsid research in that it provides, independently of structural information about the viral capsid, a high-resolution map of amino acids of functional and structural significance in the entire capsid under a variety of experimental environments. The DNA/RNA barcode system disclosed herein has provided enormous opportunities to assess transduction and tropism of a number of different AAV strains in a simple albeit high-throughput manner using only a limited number of replicated samples and animals.

Example 9

Amino Acids Important for AAV Vector Persistence at 24 Hours Post Injection

Figure 5:
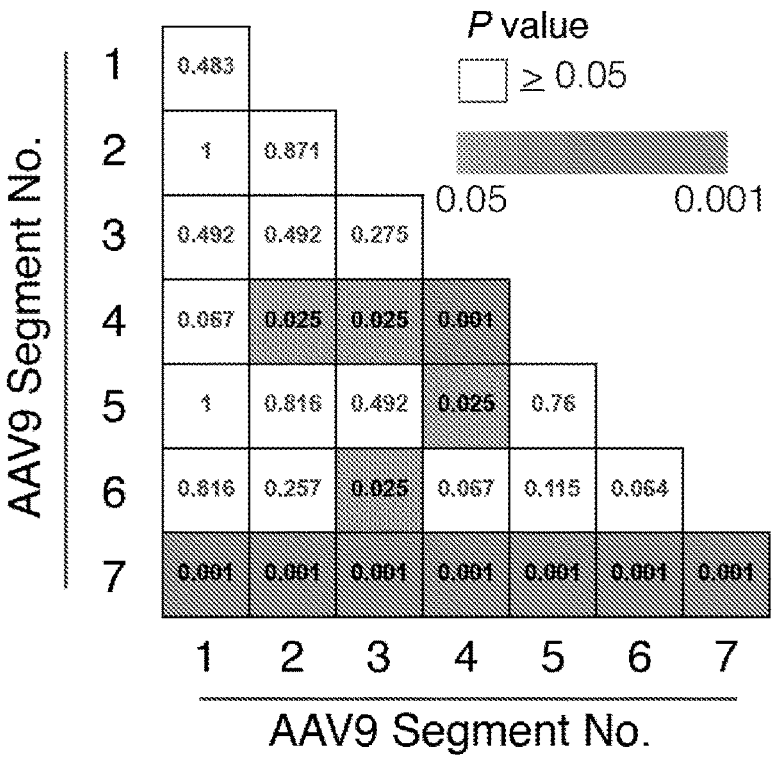
FIG. 5 is a correlation matrix with the 7 AAV9 Segments in the blood vector concentrations at 24 hours post-injection and P values. An unconditional exact test (binomial) was performed to statistically evaluate the association between various combinations of two segments from the 7 AAV9 Segments and the persistence of the AAV vector particles in the blood at 24 hours post-injection. The null hypothesis is that there is no association between the AAV9 Segments and the blood clearance. The data show that the AAV9 Segments No. 4 and 7 (SEQ ID NOs: 11 and 14) have strong associations. The combination showing statistical significance all showed positive correlation, that is, the presence of the AAV9 segments in each assessment enhanced persistence of the AAV1.9-xxxxxxx mutants in the blood.

When AAV vectors are infused into mice via the tail vein, AAV9 persists in the bloodstream for a long period of time while many other AAV serotypes are cleared from the blood circulation relatively rapidly. Disclosed herein are vectors comprising capsid proteins with amino acids responsible for persistence in the blood following intravenous injection. These were created via two approaches. In the first approach, the AAV1.9-xxxxxxx library (Library ID 521) was used. There was no significant difference in blood vector concentrations between the wild-type AAV1 and AAV1.9-xxxxxxx mutants until 4 hours post-injection, when some mutants started showing higher blood concentrations than the concentration of the wild-type AAV1 similar to AAV9 and AAV2R585E. At 24 hours post injection, a subset of AAV1.9-xxxxxxx mutants showed substantially higher blood vector concentrations up to 176-fold compared to the wild-type AAV1. Certain mutants showing high blood vector concentrations all have either the xxx9xx9 motif or the xxxx99 motif without exception. A statistical test using an unconditional exact test rejects the null hypothesis that none of the motif or combinations of the motifs are associated with blood clearance rates was performed and determined that mutations of SEQ ID NO: 4→SEQ ID NO: 11 and SEQ ID NO: 7→SEQ ID NO: 14 by themselves are strongly associated with high vector concentrations at 24 hours post injection, and the AAV9 SEQ ID NO: 14 plays the most influential role (FIG. 5).

Example 10

Amino Acids Important for AAV Vector Persistence at 72 Hours Post Injection

Figure 6:
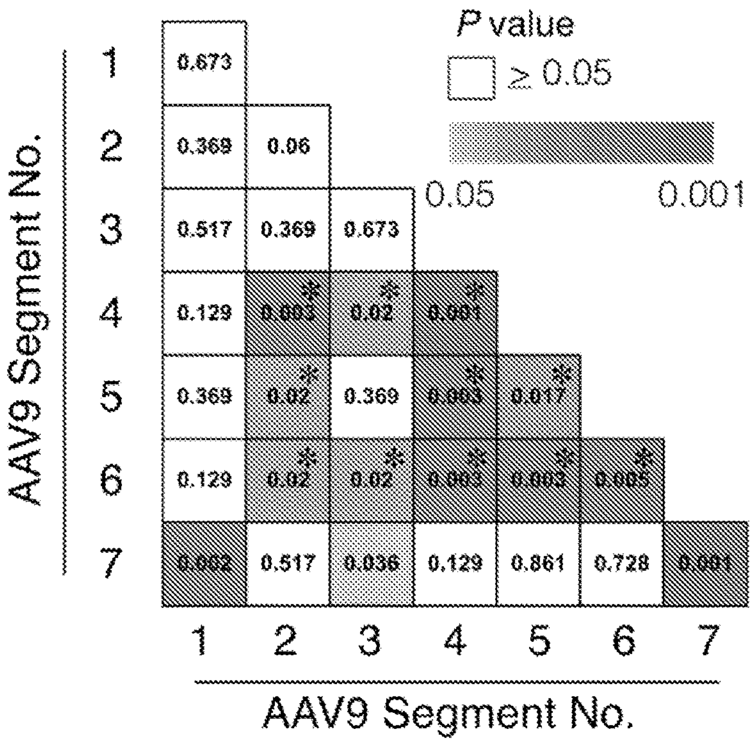
FIG. 6 is a correlation matrix with the 7 AAV9 Segments in the blood vector concentrations at 72 hours post-injection and P values. An unconditional exact test (binomial) was performed to statistically evaluate the association between various combinations of two segments from the 7 AAV9 Segments and the persistence of the AAV vector particles in the blood at 72 hours post-injection. The null hypothesis is that there is no association between the AAV9 Segments and the blood clearance. Asterisks indicate negative correlations. The data show that the AAV9 Segments No. 4, 5 and 6 (SEQ ID NOs: 11-13) have strong negative association. The AAV9 Segment No. 1 (SEQ ID NO: 8) showed strong positive association only when the segment is combined with the AAV9 Segment No. 7 (SEQ ID NO: 14), but the positive association can be diminished with combined with other segments. This indicates that having the AAV1 Segments No. 4, 5 or 6 (SEQ ID NOs: 4-6), combined with the AAV9 Segment No. 7 (SEQ ID NO: 14) can prolong the vector half-lives measured at 72 hours post-injection.

The amino acids important for AAV vector persistence at 72 hours post-injection were investigated by the same approach. Interestingly, the AAV9 Segments No. 4, 5 and 6 (SEQ ID NOs: 11-13) showed negative correlation with the sustained blood circulation at 72 hours post-injection (FIG. 6). In particular the AAV9 Segment No. 4 showed a strong negative correlation with the sustained blood circulation at 72 hours post-injection. Among the top 19 AAV1.9-xxxxxxx mutants that showed higher 72-h time point blood concentrations that the wild-type AAV1 reference controls, only one mutant had the xxx9xx9 motif and all the others had the xxx1xx9 motif. Likewise, the AAV9 Segment No. 6 (SEQ ID NO: 13) also showed a strong negative correlation with 14 of the 19 mutants having the AAV1 Segment No. 6 (SEQ ID NO: 6). Thus, the mechanisms for the persistence at 24 hours and 72 hours post-injection appear to be different. Both require AAV9 Segment No. 7 (SEQ ID NO: 14); however, AAV9 Segments No. 4 (SEQ ID NO: 11) and No. 6 (SEQ ID NO: 13) play contrasting roles although there are several exceptions depending on the context.

Example 11

Amino Acids Important for AAV Vector Persistence Using the AAV-9 AA Library

The AAV9-AA library (Library ID 507) is a double alanine scanning mutant library covering the AAV9 amino acid positions from 1 to 355. Although a majority of the mutants showed no significant difference in the blood clearance rates compared to the wild-type AAV9, the 7 mutants covering the amino acid positions from 254 to 273 exhibited significant loss of persistence at 72 hours post injection (Table 2). This demonstrates that the AAV9 amino acid segment 254-NHLYKQISNSTSGGSSNDNA-273 plays an important role for maintaining persistence of the vector in the blood.

Example 12

Enhanced Transduction to the Brain is Associated with Persistence in Blood

Among the AAV1.9-xxxxxxx mutants, some showed significantly enhanced brain transduction relative the wild-type AAV1. According to the RNA Barcode-Seq analysis, the wild-type AAV1 can transduce the brain at only 5% of the level of the wild-type AAV9. Twenty eight out of the 127 mutants showed better brain transduction by more than 4 fold, and 4 mutants, SEQ ID NO: 90, SEQ ID NO: 28, SEQ ID NO: 92 and SEQ ID NO: 114, showed brain transduction at levels comparable of the level obtainable with the wild-type AAV9. Many of those mutants with an enhanced ability to transduce the brain also exhibit blood vector concentrations that are higher than the wild-type AAV1 at either or both 24 and 72 hour time points. This association is found statistically significant (Table 4 and Table 5).

TABLE 4

Table 4. Statistical assessment of association between blood vector concentrations at 24 h and brain transduction

| Blood concentrations at 24 h | Brain transduction ≥4x of AAV1 | Brain transduction <4x of AAV1 | Total |
|---|---|---|---|
| ≥10x of AAV1 | 22 | 38 | 60 |
| <10x of AAV1 | 6 | 62 | 68 |
| Total | 28 | 100 | 128 |

Higher blood concentrations at 24 hours post-injection are strongly associated with higher brain transduction efficiency (an unconditional exact test (multinomial), P = 0.011).

TABLE 5

Table 5. Statistical assessment of association between blood vector concentrations at 72 h and brain transduction

| Blood concentrations at 72 h | Brain transduction ≥4x of AAV1 | <4x of AAV1 | Total |
|---|---|---|---|
| ≥0.5x of AAV1 | 14 | 17 | 31 |
| <0.5x of AAV1 | 14 | 83 | 97 |
| Total | 28 | 100 | 128 |

Higher blood concentrations at 72 hours post-injection are strongly associated with higher brain transduction efficiency (an unconditional exact test (multinomial), P = 0.016).

Example 13

Amino Acids Important for Enhanced Transduction in the Brain

Figure 7:
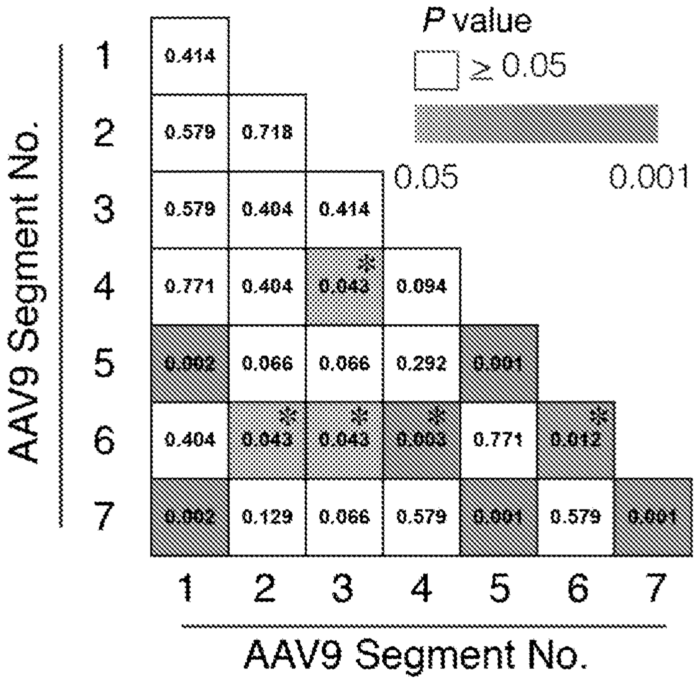
FIG. 7 is a correlation matrix with the 7 AAV9 Segments in the brain transduction and P values. An unconditional exact test (binomial) was performed to statistically evaluate the association between various combinations of two segments from the 7 AAV9 Segments and enhanced brain transduction. There are 28 mutants that showed enhanced brain transduction by more than 4 fold compared to the wild-type AAV1, and were compared with those showing brain transduction showing at levels of less than 4 fold. The null hypothesis is that there is no association between the AAV9 Segments and the brain transduction. Asterisks indicate negative correlations. The data show that the AAV9 Segments No. 3, 4 and 6 (SEQ ID NOs: 10, 11, and 13) show negative correlation with the AAV9 Segment No. 6 (SEQ ID NO: 13) showing the strongest, while the AAV9 Segments No. 5 and 7 (SEQ ID NOs: 12 and 14) showed strong positive correlation.

There is a strong correlation between the AAV9 Segments No. 5 and 7 and enhanced brain transduction (FIG. 7). However, interestingly, there is a strong negative correlation between the AAV9 Segment No. 6 and enhanced brain transduction. This indicates that having the xxxx919 motif strongly correlates with enhanced brain transduction, although other xxxxxx9 motifs also transduce the brain better than the wild-type AAV1 depending the contexts in other motifs (Table 6).

TABLE 6

Table 6. The xxxx919 motifs are associated with enhanced brain transduction

| AAV1.9-xxxx919 mutants? | Brain transduction ≥4x of AAV1 | <4x of AAV1 | Total |
|---|---|---|---|
| Yes | 14 | 2 | 16 |
| No | 14 | 98 | 112 |
| Total | 28 | 100 | 128 |

The xxxx919 motifs are strongly associated with enhanced brain transduction (an unconditional exact test (binomial), P = 0.0010).

Among the AAV1.9-xxxx919 mutants showing enhanced brain transduction, having the AAV9 Segment No. 4 (i.e., the xxx9919 motifs) consistently resulted in liver-detargeting phenotype, while having the AAV1 Segment No. 4 (i.e., the xxx1919 motifs) consistently exhibited retained or enhanced liver transduction. This indicates that the Segment No. 4 (SEQ ID NO: 4) plays an influential role in liver transduction, which is described below. Similarly, the xxxx999 and xxx11x9 motifs consistently showed liver-detargeting phenotypes. In addition, the liver-detargeting, brain transduction enhancing AAV1.9-xxxxxxx mutants are strongly associated with substantially enhanced persistence in the blood circulation measure at 24 hours post-injection, and liver transduction-retained, brain transduction enhancing AAV1.9-xxxxxxx mutants are strongly associated with retained persistence in the blood circulation measure at 72 hours post-injection. This again highlights the importance of the blood vector persistence for enhanced brain transduction.

Example 14

Amino Acids Important in Detargeting the Liver

Figure 8:
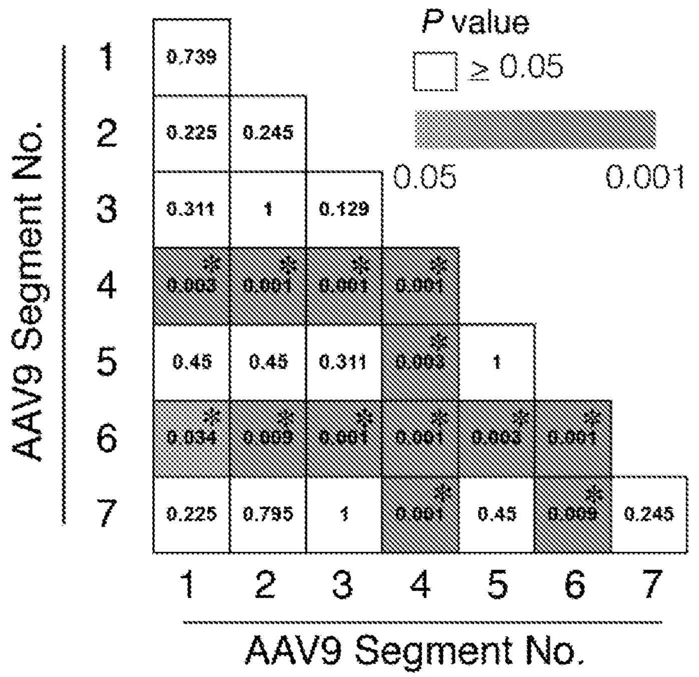
FIG. 8 is a correlation matrix with the 7 AAV9 Segments in the liver transduction and P values. An unconditional exact test (binomial) was performed to statistically evaluate the association between various combinations of two segments from the 7 AAV9 Segments and retained liver transduction. There are 34 mutants that showed retained liver transduction by more than 0.1-fold compared to the wild-type AAV1, and were compared with those showing liver de-targeting phenotypes showing at levels of less than 0.1-fold. The null hypothesis is that there is no association between the AAV9 Segments and the liver transduction. Asterisks indicate negative correlations. The data show that the AAV9 Segments No. 4 and 6 show strong negative correlation with the liver transduction. This indicates that the AAV9 Segments No. 4 and 6 are strongly correlated with liver de-targeting phenotypes.

Liver de-targeting mutants are defined herein as those having less than 10% transduction efficiency of that of the wild-type AAV1. A total of 94 liver de-targeting AAV1.9-xxxxxxx mutants were generated. As indicated above, they are strongly associated with loss of persistence at 72 hours post-injection (Table 7). A statistical analysis revealed that the AAV9 Segments No. 4 and 6 (SEQ ID NOs: 11 and 13) have a strongly negative correlation with retained liver transduction, and hence having these segments as those derived from the AAV9 capsid strongly correlates with liver de-targeting phenotypes (FIG. 8).

TABLE 7

Table 7. Statistical assessment of association between blood vector concentrations at 72 h and liver de-targeting

| Blood concentrations at 72 h | liver transduction ≥0.1x of AAV1 | <0.1x of AAV1 | Total |
|---|---|---|---|
| ≥0.5x of AAV1 | 19 | 12 | 31 |
| <0.5x of AAV1 | 15 | 82 | 97 |
| Total | 34 | 94 | 128 |

Lower blood concentrations at 72 hours post-injection are strongly associated with liver de-targeting phenotypes (an unconditional exact test (multinomial), P = 0.010).

Example 15

Amino Acids Important for Transduction in Other Tissues

AAV1.9-xxxxxxx mutants that can transduce the heart, lung, skeletal muscle and abdominal adipose tissues better than the wild-type AAV1 include the AAV9 Segment No. 7 (SEQ ID NO: 14). In addition, many of the mutants showing enhanced transduction in the lung, spleen, kidney, skeletal muscle, testis and the adipose tissue have the xxx1x19 motifs and correlate with persistent blood concentrations at 72 hours post-injection.

SEQUENCE LISTING (146 sequences)

SEQ ID NO: 1 - protein, 8 aa, Adeno Associated Virus
SAQNKDLL

SEQ ID NO: 2 - protein, 8 aa, Adeno Associated Virus
RGSPAGMS

SEQ ID NO: 3 - protein, 5 aa, Adeno Associated Virus
KTKTD

SEQ ID NO: 4 - protein, 5 aa, Adeno Associated Virus
NFTWT

SEQ ID NO: 5 - protein, 11 aa, Adeno Associated Virus
KYNLNGRESII

SEQ ID NO: 6 - protein, 13 aa, Adeno Associated Virus
DDEDKFFPMSGVM

SEQ ID NO: 7 - protein, 23 aa, Adeno Associated Virus
ESAGASNTALDNVMITDEEEIKA

SEQ ID NO: 8 - protein, 7 aa, Adeno Associated Virus
QNQQTLK

SEQ ID NO: 9 - protein, 8 aa, Adeno Associated Virus
VAGPSNMA

SEQ ID NO: 10 - protein, 5 aa, Adeno Associated Virus
TTVTQ

SEQ ID NO: 11 - protein, 5 aa, Adeno Associated Virus
EFAWP

SEQ ID NO: 12 - protein, 11 aa, Adeno Associated Virus
SWALNGRNSLM

SEQ ID NO: 13 - protein, 13 aa, Adeno Associated Virus
EGEDRFFPLSGSL

SEQ ID NO: 14 - protein, 23 aa, Adeno Associated Virus
QGTGRDNVDADKVMITNEEEIKT

SEQ ID NO: 15 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 16 - protein, 737 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 17 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSEFAWPGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 18 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSEFAWPGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 19 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 20 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSNFTWTGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 21 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSEFAWPGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 22 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSEFAWPGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 23 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 24 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 25 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSEFAWPGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 26 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSEFAWPGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 27 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSNFTWTGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 28 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSNFTWTGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 29 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSEFAWPGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 30 - protein, 737 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSEFAWPGASKSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 31 - protein, 737 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKEGEDRFFPLSGSLMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 32 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 33 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSEFAWPGASKYNLNGRESIINPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 34 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSEFAWPGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 35 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSNFTWTGASKYNLNGRESIINPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 36 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSNFTWTGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 37 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSEFAWPGASKYNLNGRESIINPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 38 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSEFAWPGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 39 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 40 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 41 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSEFAWPGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 42 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSEFAWPGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 43 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSNFTWTGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 44 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSNFTWTGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 45 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSEFAWPGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 46 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSTTVTQNNNSEFAWPGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 47 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 48 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSNFTWTGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 49 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSEFAWPGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 50 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSEFAWPGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 51 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 52 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSNFTWTGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 53 - protein, 736 aa, Adeno Associated Virus; identical to SEQ ID NO: 52

SEQ ID NO: 54 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSEFAWPGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 55 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSNFTWTGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 56 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSNFTWTGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 57 - protein, 736 aa, Adeno Associated Virus; identical to SEQ ID NO: 25

SEQ ID NO: 58 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSEFAWPGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 59 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSNFTWTGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 60 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSNFTWTGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 61 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSEFAWPGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 62 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSEFAWPGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 63 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSNFTWTGASKYNLNGRESIINPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 64 - protein, 728 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSNFTWTGASSWALNGRNSLMNPEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 65 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSEFAWPGASKYNLNGRESIINPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 66 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSEFAWPGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 67 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSNFTWTGASKYNLNGRESIINPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 68 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSNFTWTGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 69 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSEFAWPGASKYNLNGRESIINPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 70 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSEFAWPGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 71 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSNFTWTGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 72 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSNFTWTGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 73 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSEFAWPGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 74 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSKTKTDNNNSEFAWPGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 75 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSNFTWTGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 76 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSNFTWTGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 77 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSEFAWPGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 78 - protein, 736 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSVAGPSNMAVQPKNWLPGPCYRQQRVSTTVTQNNNSEFAWPGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 79 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 80 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSNFTWTGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 81 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSEFAWPGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 82 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSEFAWPGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 83 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 84 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSNFTWTGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 85 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSEFAWPGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 86 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSEFAWPGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 87 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSNFTWTGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 88 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSNFTWTGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 89 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSEFAWPGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 90 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSEFAWPGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 91 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSNFTWTGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 92 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSNFTWTGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 93 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSEFAWPGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 94 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSEFAWPGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 95 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSNFTWTGASKYNLNGRESIINPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 96 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSNFTWTGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 97 - skipped

SEQ ID NO: 98 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSEFAWPGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 99 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSNFTWTGASKYNLNGRESIINPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 100 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSNFTWTGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 101 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSEFAWPGASKYNLNGRESIINPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 102 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSEFAWPGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 103 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSNFTWTGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 104 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSNFTWTGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 105 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSEFAWPGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 106 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSKTKTDNNNSEFAWPGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 107 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSNFTWTGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 108 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSNFTWTGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 109 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSEFAWPGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 110 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSRGSPAGMSVQPKNWLPGPCYRQQRVSTTVTQNNNSEFAWPGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 111 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 112 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSNFTWTGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 113 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSEFAWPGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 114 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSEFAWPGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 115 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 116 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSNFTWTGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 117 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSEFAWPGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 118 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSEFAWPGASSWALNGRNSLMNPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 119 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSNFTWTGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 120 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSNFTWTGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 121 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSEFAWPGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 122 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSEFAWPGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 123 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSNFTWTGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 124 - protein, 675 aa, Adeno Associated Virus
KGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSNFTWTGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 125 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSEFAWPGASKYNLNGRESIINPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 126 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSEFAWPGASSWALNGRNSLMNPGTAMASHKDDEDKFFPMSGVMIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 127 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSNFTWTGASKYNLNGRESIINPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 128 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSNFTWTGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 129 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSEFAWPGASKYNLNGRESIINPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 130 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSEFAWPGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 131 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSNFTWTGASKYNLNGRESIINPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 132 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSNFTWTGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 133 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSEFAWPGASKYNLNGRESIINPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 134 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSEFAWPGASSWALNGRNSLMNPGTAMASHKEGEDRFFPLSGSLIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 135 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSNFTWTGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 136 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSNFTWTGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 137 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSEFAWPGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 138 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSKTKTDNNNSEFAWPGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 139 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSNFTWTGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 140 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSNFTWTGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 141 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSEFAWPGASKYNLNGRESIINPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 142 - protein, 735 aa, Adeno Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGQNQQTLKFSVAGPSNMAVQPKNWLPGPCYRQQRVSTTVTQNNNSEFAWPGASSWALNGRNSLMNPGTAMASHKEGEDRFFPLSGSLIFGKQGTGRDNVDADKVMITNEEEIKTTNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 143 - protein, 20 aa, Adeno Associated Virus
NHLYKQISSASTGASNDNHY

SEQ ID NO: 144 - protein, 20 aa, Adeno Associated Virus
NHLYKQISNSTSGGSSNDNA

SEQ ID NO: 145 - protein, 735 aa, Adeno Associated Virus [sequence omitted]

SEQ ID NO: 146 - protein, 734 aa, Adeno Associated Virus
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

The invention claimed is:

1. A recombinant adeno-associated virus (rAAV) comprising a capsid protein, wherein the capsid protein comprises the amino acid sequence of SEQ ID NO: 15, and wherein said capsid protein comprises the mutations: E546Q, S547G, A548T, A550R, S551D, T553V, T554D, L555A, N557K, D562N, and A568T.

2. The rAAV of claim 1, wherein said rAAV comprises a vector, and said vector persists in the blood of a subject at least 24 hours after injection of said vector into said subject.

3. The rAAV of claim 1, wherein said capsid protein further comprises mutations selected from the group consisting of: (i) N500E, T502A, and T504P, (ii) D529E, D530G, K533R, M537L, V540S, and M541L, and (iii) K5085, Y509W, N510A, E515N, I517L, and I518M.

4. The rAAV of claim 1, wherein said rAAV comprises a vector, and said vector persists in said blood of a subject at least 72 hours after injection of said vector into said subject.

5. The rAAV of claim 1, wherein said rAAV comprises a vector, and said vector concentrates in a liver of a subject at a concentration of 0.1× or lower relative to an adeno-associated virus comprising a VP capsid of SEQ ID NO: 15.

6. The rAAV of claim 1, wherein said rAAV comprises a vector, and said rAAV comprising said vector transduces a brain of a subject at least 4× more readily than an adeno-associated virus comprising a capsid of SEQ ID NO: 15.

7. The rAAV of claim 1, wherein said rAAV comprises a vector, and rAAV comprising said vector transduces one or more of pancreas, liver, skeletal muscle, visceral fat, heart, liver, lung, or kidney of a subject at least 4× more readily than an adeno-associated virus comprising a capsid of SEQ ID NO: 15.

* * * * *